US011261446B2

(12) United States Patent
Jafar-nejad

(10) Patent No.: US 11,261,446 B2
(45) Date of Patent: Mar. 1, 2022

(54) COMPOUNDS AND METHODS FOR MODULATING UBE3A-ATS

(71) Applicant: Ionis Pharmaceuticals, Inc., Carlsbad, CA (US)

(72) Inventor: Paymaan Jafar-nejad, Carlsbad, CA (US)

(73) Assignee: Ionis Pharmaceuticals, Inc., Carlsbad, CA (US)

( * ) Notice: Subject to any disclaimer, the term of this patent is extended or adjusted under 35 U.S.C. 154(b) by 0 days.

(21) Appl. No.: 17/236,671

(22) Filed: Apr. 21, 2021

(65) Prior Publication Data

US 2021/0277397 A1 Sep. 9, 2021

Related U.S. Application Data

(63) Continuation of application No. PCT/US2020/025110, filed on Mar. 27, 2020.

(60) Provisional application No. 62/877,765, filed on Jul. 23, 2019, provisional application No. 62/826,521, filed on Mar. 29, 2019.

(51) Int. Cl.
  *C07H 21/04* (2006.01)
  *C12N 15/113* (2010.01)

(52) U.S. Cl.
  CPC ...... *C12N 15/113* (2013.01); *C12N 2310/111* (2013.01); *C12N 2310/113* (2013.01); *C12N 2310/315* (2013.01); *C12N 2310/321* (2013.01); *C12N 2310/323* (2013.01); *C12N 2310/3341* (2013.01); *C12N 2310/341* (2013.01)

(58) Field of Classification Search
  None
  See application file for complete search history.

(56) References Cited

U.S. PATENT DOCUMENTS

| | | | |
|---|---|---|---|
| 3,687,808 A | 8/1972 | Merigan et al. |
| 4,415,732 A | 11/1983 | Caruthers et al. |
| 4,469,863 A | 9/1984 | Ts'o et al. |
| 4,476,301 A | 10/1984 | Imbach et al. |
| 4,500,707 A | 2/1985 | Caruthers et al. |
| 4,725,677 A | 2/1988 | Koster et al. |
| 4,845,205 A | 7/1989 | Huynh Dinh et al. |
| 4,973,679 A | 11/1990 | Caruthers et al. |
| 4,981,957 A | 1/1991 | Lableu et al. |
| 5,013,830 A | 5/1991 | Ohutsuka et al. |
| 5,023,243 A | 6/1991 | Tullis |
| 5,034,506 A | 7/1991 | Summerton et al. |
| 5,118,800 A | 6/1992 | Smith et al. |
| 5,130,302 A | 7/1992 | Spielvogel et al. |
| 5,132,418 A | 7/1992 | Caruthers et al. |
| 5,134,066 A | 7/1992 | Rogers et al. |
| RE34,036 E | 8/1992 | McGeehan |
| 5,149,797 A | 9/1992 | Pederson et al. |
| 5,166,315 A | 11/1992 | Summerton et al. |
| 5,175,273 A | 12/1992 | Bischofberger et al. |
| 5,177,196 A | 1/1993 | Meyer, Jr. et al. |
| 5,177,198 A | 1/1993 | Spielvogel et al. |
| 5,185,444 A | 2/1993 | Summerton et al. |
| 5,188,897 A | 2/1993 | Suhadolnik et al. |
| 5,194,599 A | 3/1993 | Froehler et al. |
| 5,214,134 A | 5/1993 | Weis et al. |
| 5,216,141 A | 6/1993 | Benner |
| 5,220,007 A | 6/1993 | Pederson et al. |
| 5,223,618 A | 6/1993 | Cook et al. |
| 5,235,033 A | 8/1993 | Summerton et al. |
| 5,256,775 A | 10/1993 | Froehler |
| 5,264,423 A | 11/1993 | Cohen et al. |
| 5,264,562 A | 11/1993 | Matteucci |
| 5,264,564 A | 11/1993 | Matteucci |
| 5,276,019 A | 1/1994 | Cohen et al. |
| 5,286,717 A | 2/1994 | Cohen et al. |
| 5,319,080 A | 6/1994 | Leumann |
| 5,321,131 A | 6/1994 | Agrawal et al. |
| 5,359,044 A | 10/1994 | Cook et al. |
| 5,366,878 A | 11/1994 | Pederson et al. |
| 5,367,066 A | 11/1994 | Urdea et al. |
| 5,378,825 A | 1/1995 | Cook et al. |
| 5,386,023 A | 1/1995 | Sanghvi et al. |

(Continued)

FOREIGN PATENT DOCUMENTS

| EP | 1764108 | 3/2008 |
|---|---|---|
| WO | WO 1998/39352 | 9/1998 |

(Continued)

OTHER PUBLICATIONS

Albaek et al., "Analogues of a Locked Nucleic Acid with Three-Carbon 2',4'-Linkages: Synthesis by Ring-Closing Metathesis and Influence of Nucleic Acid Duplex Stability" J. Org, Chem. (2006) 71:7731-7740.

Allshire, "Molecular biology. RNAi and heterochromatin—a hushed-up affair" Science (2002) 297(5588):1818-1819.

Altmann et al., "Second Generation Antisense Oligonucleotides—Inhibition of PKC-α and c-raf Kinase Expression by Chimeric Oligonucleotides Incorporating 6"-Substituted Carbocyclic Nucleosides and 2"-O-Ethylene Glycol Substituted Ribonucleosides" Nuclewsodies Nucleotides. (1997) 16:917-926.

(Continued)

*Primary Examiner* — Kimberly Chong
(74) *Attorney, Agent, or Firm* — McNeill Baur PLLC

(57) ABSTRACT

Provided are compounds, methods, and pharmaceutical compositions for reducing the amount or activity of UBE3A-ATS, the endogenous antisense transcript of ubiquitin protein ligase E3A (UBE3A) in a cell or subject, and in certain instances increasing the expression of paternal UBE3A and the amount of UBE3A protein in a cell or subject. Such compounds, methods, and pharmaceutical compositions are useful to ameliorate at least one symptom or hallmark of a neurogenetic disorder. Such symptoms and hallmarks include developmental delays, ataxia, speech impairment, sleep problems, seizures, and EEG abnormalities. Such neurogenetic disorders include Angelman Syndrome.

17 Claims, No Drawings

Specification includes a Sequence Listing.

(56) References Cited

U.S. PATENT DOCUMENTS

| | | |
|---|---|---|
| 5,393,878 A | 2/1995 | Leumann |
| 5,399,676 A | 3/1995 | Froehler |
| 5,403,711 A | 4/1995 | Walder et al. |
| 5,405,938 A | 4/1995 | Sumerton et al. |
| 5,405,939 A | 4/1995 | Suhadolnik et al. |
| 5,432,272 A | 7/1995 | Benner |
| 5,434,257 A | 7/1995 | Matteucci |
| 5,446,137 A | 8/1995 | Maag et al. |
| 5,453,496 A | 9/1995 | Caruthers et al. |
| 5,455,233 A | 10/1995 | Spielvogel et al. |
| 5,457,187 A | 10/1995 | Gmelner et al. |
| 5,457,191 A | 10/1995 | Cook et al. |
| 5,459,255 A | 10/1995 | Cook et al. |
| 5,466,677 A | 11/1995 | Baxter et al. |
| 5,466,786 A | 11/1995 | Buhr et al. |
| 5,470,967 A | 11/1995 | Huie et al. |
| 5,476,925 A | 12/1995 | Letsinger et al. |
| 5,484,908 A | 1/1996 | Froehler et al. |
| 5,489,677 A | 2/1996 | Sanghvi et al. |
| 5,491,133 A | 2/1996 | Walder et al. |
| 5,502,177 A | 3/1996 | Matteucci et al. |
| 5,508,270 A | 4/1996 | Baxter et al. |
| 5,514,785 A | 5/1996 | Van Ness et al. |
| 5,519,126 A | 5/1996 | Hecht |
| 5,519,134 A | 5/1996 | Acevedo et al. |
| 5,525,711 A | 6/1996 | Hawkins et al. |
| 5,527,899 A | 6/1996 | Froehler |
| 5,536,821 A | 7/1996 | Agrawal et al. |
| 5,541,306 A | 7/1996 | Agrawal et al. |
| 5,541,307 A | 7/1996 | Cook et al. |
| 5,550,111 A | 8/1996 | Suhadolnik et al. |
| 5,552,540 A | 9/1996 | Haralambidis |
| 5,561,225 A | 10/1996 | Maddry et al. |
| 5,563,253 A | 10/1996 | Agrawal et al. |
| 5,565,350 A | 10/1996 | Kmiec |
| 5,565,555 A | 10/1996 | Froehler et al. |
| 5,567,811 A | 10/1996 | Mistura et al. |
| 5,571,799 A | 11/1996 | Tkachuk et al. |
| 5,576,427 A | 11/1996 | Cook et al. |
| 5,587,361 A | 12/1996 | Cook et al. |
| 5,587,469 A | 12/1996 | Cook et al. |
| 5,587,470 A | 12/1996 | Cook et al. |
| 5,591,722 A | 1/1997 | Montgomery et al. |
| 5,594,121 A | 1/1997 | Froehler et al. |
| 5,596,086 A | 1/1997 | Matteucci |
| 5,596,091 A | 1/1997 | Switzer |
| 5,597,909 A | 1/1997 | Urdea et al. |
| 5,602,240 A | 2/1997 | De Mesmaeker et al. |
| 5,608,046 A | 3/1997 | Cook et al. |
| 5,610,289 A | 3/1997 | Cook et al. |
| 5,610,300 A | 3/1997 | Altmann et al. |
| 5,614,617 A | 3/1997 | Cook et al. |
| 5,618,704 A | 4/1997 | Sanghvi et al. |
| 5,623,065 A | 4/1997 | Cook et al. |
| 5,623,070 A | 4/1997 | Cook et al. |
| 5,625,050 A | 4/1997 | Beaton et al. |
| 5,627,053 A | 5/1997 | Usman et al. |
| 5,633,360 A | 5/1997 | Bishofberger et al. |
| 5,639,873 A | 6/1997 | Barascut et al. |
| 5,645,985 A | 7/1997 | Froehler et al. |
| 5,646,265 A | 7/1997 | McGee |
| 5,646,269 A | 7/1997 | Matteucci |
| 5,652,355 A | 7/1997 | Metelev et al. |
| 5,652,356 A | 7/1997 | Agrawal |
| 5,663,312 A | 9/1997 | Chaturvedula |
| 5,670,633 A | 9/1997 | Cook et al. |
| 5,672,697 A | 9/1997 | Buhr et al. |
| 5,677,437 A | 10/1997 | Teng et al. |
| 5,677,439 A | 10/1997 | Weis et al. |
| 5,681,941 A | 10/1997 | Cook et al. |
| 5,698,685 A | 12/1997 | Summerton et al. |
| 5,700,920 A | 12/1997 | Altmann et al. |
| 5,700,922 A | 12/1997 | Cook |
| 5,721,218 A | 2/1998 | Froehler |
| 5,750,692 A | 5/1998 | Cook et al. |
| 5,763,588 A | 6/1998 | Matteucci et al. |
| 5,792,608 A | 8/1998 | Swaminathan et al. |
| 5,792,847 A | 8/1998 | Buhr et al. |
| 5,801,154 A | 9/1998 | Baracchini et al. |
| 5,808,027 A | 9/1998 | Cook et al. |
| 5,830,653 A | 11/1998 | Froehler et al. |
| 5,859,221 A | 1/1999 | Cook et al. |
| 5,948,903 A | 9/1999 | Cook et al. |
| 5,994,517 A | 11/1999 | Ts'O |
| 6,005,087 A | 12/1999 | Cook et al. |
| 6,005,096 A | 12/1999 | Matteucci et al. |
| 6,166,199 A | 12/2000 | Cook et al. |
| 6,184,212 B1 | 2/2001 | Miraglia et al. |
| 6,268,490 B1 | 7/2001 | Imanishi et al. |
| 6,300,132 B1 | 10/2001 | Monia et al. |
| 6,300,319 B1 | 10/2001 | Manoharan |
| 6,426,220 B1 | 7/2002 | Bennett et al. |
| 6,525,191 B1 | 2/2003 | Ramasamy |
| 6,531,584 B1 | 3/2003 | Cook et al. |
| 6,582,908 B2 | 6/2003 | Fodor et al. |
| 6,600,032 B1 | 7/2003 | Manoharan et al. |
| 6,617,162 B2 | 9/2003 | Dobie et al. |
| 6,660,720 B2 | 12/2003 | Manoharan |
| 6,670,461 B1 | 12/2003 | Wengel et al. |
| 6,770,748 B2 | 8/2004 | Imanishi et al. |
| 6,794,499 B2 | 9/2004 | Wengel et al. |
| 7,015,315 B1 | 3/2006 | Cook et al. |
| 7,034,133 B2 | 4/2006 | Wengel et al. |
| 7,053,207 B2 | 5/2006 | Wengel |
| 7,101,993 B1 | 9/2006 | Cook et al. |
| 7,262,177 B2 | 8/2007 | Ts'o et al. |
| 7,399,845 B2 | 7/2008 | Seth et al. |
| 7,427,672 B2 | 9/2008 | Imanishi et al. |
| 7,491,805 B2 | 2/2009 | Vargeese et al. |
| 7,547,684 B2 | 6/2009 | Seth et al. |
| 7,569,686 B1 | 8/2009 | Bhat et al. |
| 7,666,854 B2 | 2/2010 | Seth et al. |
| 7,696,345 B2 | 4/2010 | Allerson et al. |
| 7,723,509 B2 | 5/2010 | Manoharan et al. |
| 7,741,457 B2 | 6/2010 | Swayze et al. |
| 7,750,131 B2 | 7/2010 | Seth et al. |
| 7,820,809 B2 | 10/2010 | Khvorova et al. |
| 7,875,733 B2 | 1/2011 | Bhat et al. |
| 7,888,497 B2 | 2/2011 | Bentwich et al. |
| 7,939,677 B2 | 5/2011 | Bhat et al. |
| 8,022,193 B2 | 9/2011 | Swayze et al. |
| 8,030,467 B2 | 10/2011 | Seth et al. |
| 8,080,644 B2 | 12/2011 | Wengel et al. |
| 8,088,746 B2 | 1/2012 | Seth et al. |
| 8,088,904 B2 | 1/2012 | Swayze et al. |
| 8,106,022 B2 | 1/2012 | Manoharan et al. |
| 8,124,745 B2 | 2/2012 | Allerson et al. |
| 8,153,365 B2 | 4/2012 | Wengel et al. |
| 8,268,980 B2 | 9/2012 | Seth et al. |
| 8,278,283 B2 | 10/2012 | Seth et al. |
| 8,278,425 B2 | 10/2012 | Prakash et al. |
| 8,278,426 B2 | 10/2012 | Seth et al. |
| 8,440,803 B2 | 5/2013 | Swayze et al. |
| 8,501,805 B2 | 8/2013 | Seth et al. |
| 8,530,640 B2 | 9/2013 | Seth et al. |
| 8,546,556 B2 | 10/2013 | Seth et al. |
| RE44,779 E | 2/2014 | Imanishi et al. |
| 8,828,956 B2 | 9/2014 | Manoharan et al. |
| 9,005,906 B2 | 4/2015 | Swayze et al. |
| 9,012,421 B2 | 4/2015 | Migawa et al. |
| 9,127,276 B2 | 8/2015 | Prakash et al. |
| 9,290,760 B2 | 3/2016 | Rajeev et al. |
| 9,359,603 B2 | 6/2016 | Lutz et al. |
| 9,617,539 B2 | 4/2017 | Rigo et al. |
| 10,253,312 B2 | 4/2019 | Maeder et al. |
| 10,400,243 B2 | 9/2019 | Whipple et al. |
| 2001/0053519 A1 | 12/2001 | Fodor et al. |
| 2003/0087855 A1 | 5/2003 | Ward et al. |
| 2003/0158403 A1 | 8/2003 | Manoharan et al. |
| 2003/0175906 A1 | 9/2003 | Manoharan et al. |
| 2003/0228597 A1 | 12/2003 | Cowsert et al. |
| 2004/0171570 A1 | 9/2004 | Allerson et al. |
| 2005/0130923 A1 | 6/2005 | Bhat et al. |
| 2006/0148740 A1 | 7/2006 | Platenburg |

(56) References Cited

U.S. PATENT DOCUMENTS

| | | |
|---|---|---|
| 2007/0031844 A1 | 2/2007 | Khvorova et al. |
| 2007/0111227 A1 | 5/2007 | Green et al. |
| 2008/0039618 A1 | 2/2008 | Allerson et al. |
| 2008/0108583 A1 | 5/2008 | Feinstein et al. |
| 2009/0012281 A1 | 1/2009 | Swayze et al. |
| 2010/0190837 A1 | 7/2010 | Migawa et al. |
| 2010/0197762 A1 | 8/2010 | Swayze et al. |
| 2013/0130378 A1 | 5/2013 | Manoharan et al. |
| 2013/0225659 A1 | 8/2013 | Bennett et al. |
| 2014/0107330 A1 | 4/2014 | Freier et al. |
| 2014/0315992 A1 | 10/2014 | Hakonarson et al. |
| 2015/0018540 A1 | 1/2015 | Prakash et al. |
| 2015/0141320 A1 | 5/2015 | Kreig et al. |
| 2015/0184153 A1 | 7/2015 | Freier et al. |
| 2015/0191723 A1 | 7/2015 | Rigo et al. |
| 2015/0191727 A1 | 7/2015 | Migawa et al. |
| 2015/0267195 A1 | 9/2015 | Seth et al. |
| 2015/0275212 A1 | 10/2015 | Albaek et al. |
| 2017/0362592 A1 | 12/2017 | Whipple et al. |
| 2019/0048337 A1 | 2/2019 | Hsu et al. |

FOREIGN PATENT DOCUMENTS

| | | |
|---|---|---|
| WO | WO 1999/014226 | 3/1999 |
| WO | WO 2000/063364 | 10/2000 |
| WO | WO 2001/049687 | 7/2001 |
| WO | WO 2001/092582 | 12/2001 |
| WO | WO 2003/004602 | 1/2003 |
| WO | WO 2004/035765 | 10/2003 |
| WO | WO 2004/016754 | 2/2004 |
| WO | WO 2004/106356 | 12/2004 |
| WO | WO 2005/021570 | 3/2005 |
| WO | WO 2005/121371 | 12/2005 |
| WO | WO 2006/047842 | 5/2006 |
| WO | WO 2007/087113 | 8/2007 |
| WO | WO 2007/134181 | 11/2007 |
| WO | WO 2008/101157 | 8/2008 |
| WO | WO 2008/150729 | 12/2008 |
| WO | WO 2008/154401 | 12/2008 |
| WO | WO 2009/006478 | 1/2009 |
| WO | WO 2009/067647 | 5/2009 |
| WO | WO 2009/100320 | 8/2009 |
| WO | WO 2010/036696 | 4/2010 |
| WO | WO 2010/036698 | 4/2010 |
| WO | WO 2011/017521 | 2/2011 |
| WO | WO 2011/079261 | 6/2011 |
| WO | WO 2011/109398 | 9/2011 |
| WO | WO 2011/139702 | 11/2011 |
| WO | WO 2012/009402 | 1/2012 |
| WO | WO 2012/012467 | 1/2012 |
| WO | WO 2012/064806 | 5/2012 |
| WO | WO 2013/033230 | 7/2013 |
| WO | WO 2013/173637 | 11/2013 |
| WO | WO 2014/004572 | 1/2014 |
| WO | WO 2014/036525 | 3/2014 |
| WO | WO 2016/086104 | 6/2016 |
| WO | WO 2017/081223 | 5/2017 |
| WO | WO 2017/081250 | 5/2017 |
| WO | WO 2019/084050 | 5/2019 |
| WO | WO 2019/109001 | 6/2019 |
| WO | WO 2020/205463 | 10/2020 |

OTHER PUBLICATIONS

Altmann et al., "Second Generation of Antisense Oligonucleotides: From Nuclease Resistance to Biological Efficacy in Animals" Chimia. (1996) 50(4):168-176.
Altmann et al., "Second-generation antisense oligonucleotides: structure—activity relationships and the design of improved signal-transduction inhibitors" Biochem. Soc. Trans. (1996) 24:630-637.
Altschul et al., "Basic Local Alignment Search Tool" J. Mol. Biol. (1990) 215:403-410.
Baker et al., "2'-O-(2-Methoxy)ethyl-modified Anti-intercellular Adhesion Molecule 1 (ICAM-1) Oligonucleotides Selectively Increase the ICAM-1 mRNA Level and Inhibit Formation of the ICAM-1 Translation Initiation Complex in Human Umbilical Vein Endothelial Cells" J. Biol. Chem. (1997) 272:11994-12000.
Beaudet et al., "Angelman syndrome: Drugs to awaken a paternal gene," Nature (2012) 481: 150-152.
Braasch et al., "Locked nucleic acid (LNA): fine-tuning the recognition of DNA and RNA" Chem. Biol. (2001) 8:1-7.
Braasch et al., "Novel antisense and peptide nucleic acid strategies for controlling gene expression" Biochemistry (2002) 41(14):4503-4510.
Branch et al., "A good antisense molecule is hard to find," TIBS (1998) 23:45-50.
Buiting et al., "Angelman syndrome—insights into a rare neurogenetic disorder" Nat Rev Neurol (2016) 12:584-593.
Cattanach et al., "A candidate model for Angelman syndrome in the mouse" Mamm. Genome (1997) 8(7):472-478.
Chamberlain et al., "Angelman Syndrome, a Genomic Imprinting Disorder of the Brain" J Neorosc (2010) 30: 9958-9963.
Chamberlain et al., "Induced pluripotent stem cell models of the genomic imprinting disorders Angelman and Prader-Willi syndromes" PNAS (2010) 107: 17668-17673.
Chen et al., "Motor coordination deficits in Alpk1 mutant mice with the inserted piggyBac transposon" BMC Neruosci. (2011) 12:1.
Chin "On the Preparation and Utilization of Isolated and Purified Oligonucleotides" Document purportedly located on a CD-ROM and contributed to the public collection of the Katherine R. Everett Law Library of the University of North Carolina on Mar. 14, 2002.
Chung et al., "Prader-Willi syndrome: reflections on seminal studies and future therapies" Open Biol (2020) 10:200195.
Church et al., "Lineage-specific biology revealed by a finished genome assembly of the mouse" PLoS Biol. (2009) 7: e1000112.
Clark et al., "Purkinje cell expression of a mutant allele of SCA1 in transgenic mice leads to disparate effects on motor behaviors, followed by a progressive cerebellar dysfunction and histological alterations" J. Neurosci. (1997) 17(19):7385-7395.
Crooke et al., "Basic Principles of Antisense Therapeutics" Antisense Research and Application (1998) Chapter 1:1-50.
Crooke et al., "Pharmacokinetic Properties of Several Novel Oligonucleotide Analogs in mice" J. Pharmacol. Exp. Ther. (1996) 277(2):923-937.
Crooke, St., et al., "Antisense Drug Technology" Second Edition, CRC Press (2008) Chapters 1-28.
Crooke et al., "Basic Principles of Antisense Technology" Antisense Drug Technology: Principles, Strategies and Applications (2001) p. 1-18.
Danckwardt et al., "Focus Quality Control 3' end mRNA processing: molecular mechanisms and implications for health and disease" EMBO J (2008) 27: 482-498.
Dindot et al., "The Angelman syndrome ubiquitin ligase localizes to the synapse and nucleus, and maternal deficiency results in abnormal dendritic spine morphology" Hum. Mol. Genet. (2008) 17(1): 111-118.
Efthymiou et al., "Functional Screening Assays with Neurons Generated from Pluripotent Stem Cell-Derived Neural Stem Cells" J Biomol Screen (2014) 19: 32-43.
Egli, et al., "Synthesis, improved antisense activity and structural rationale for the divergent RNA affinities of 3'-fluoro hexitol nucleic acid (FHNA and Ara-FHNA) modified oligonucleotides." J Am Chem (2011) 133(41):16642-16649.
Elayadi et al., "Application of PNA and LNA oligomers to chemotherapy" Curr. Opinion Invens. Drugs (2001) 2:558-561.
Faghihi et al., "RNAi screen indicates widespread biological function for human natural antisense transcripts" PLoS One (2010) 5(10):e13177.
Faghihi et al., "Regulatory roles of natural antisense transcripts" Nat Rev Mol Cell Biol (2009) 10: 637-643.
Fink et al, "Disrupted neuronal maturation in Angelman syndrome-derived induced pluripotent stem cells." Nat. Commun. (2017) 8:1-14.
Freier et al., "The ups and downs of nucleic acid duplex stability: structure-stability studies on chemically-modified DNA:RNA duplexes" Nucleic Acids Research (1997) 25(22):4429-4443.

(56) References Cited

OTHER PUBLICATIONS

Freier et al., "Methods of Selecting Sites in RNA for Antisense Targeting" Antisense Drug Technology: Principles, Strategies and Application (2001) p. 107-118.
Frieden et al., "Expanding the design horizon of antisense oligonucleotides with alpha-L-LNA" Nucleic Acids Research (2003) 31(21):6365-6372.
Gautschi et al., "Activity of a novel bcl-2/bcl-xLbispecific antisense oligonucleotide against tumors of diverse histologic origins" J. Natl. Cancer Inst. (2001) 93:463-471.
GenBank Accession NC 000015.10, Aug. 1, 2020.
GenBank Accession NM 130838.1, Aug. 4, 2021.
Germain, "Developing Novel Therapeutic Approaches for Angelman Syndrome Using Human iPSCs" ASF Scientific Meeting (2019).
Gu et al., "Base pairing properties of D- and L-cyclohexene nucleic acids (CeNA)" Oligonucleotides (2003) 13(6):479-489.
Gu et al., "Enzymatic resolution and base pairing properties of D- and L-cyclohexenyl nucleic acids (CeNA)" Nucleosides Nucleotides Nucleic Acids (2005) 24(5-7):993-998.
Gu et al., "Synthesis of enantiomeric-pure cyclohexenyl nucleoside building blocks for oligonucleotide synthesis" Tetrahedron (2004) 60(9):2111-2123.
Hagedorn et al., "Locked nucleic acid: modality, diversity, and drug discovery" Drug Discovery Today (2018)23: 101-114.
Hall et al., "Establishment and maintenance of a heterochromatin domain" Science (2002) 297(5590):2232-2237.
Hawkins et al., "Transcriptional regulation of Oct4 by a long non-coding RNA antisense to Oct4-pseudogene 5" Transcription (2010) 1(3):165-175.
Horvath et al., "Stereoselective synthesis of (−)-ara-cyclohexenyl-adenine" Tetrahedron Letters (2007) 48:3621-3623.
Huang et al., "Topoisomerase inhibitors unsilence the dormant allele of Ube3a in neurons" Nature (2012) 481(3780): 185-189.
Jenuwein, "Molecular biology. An RNA-guided pathway for the epigenome" Science (2002) 297(5590):2215-2218.
Jiang et al., "Mutation of the Angelman ubiquitin ligase in mice causes increased cytoplasmic p53 and deficits of contextual learning and long-term potentiation" Neruon (1998) 21(4):799-811.
Kabanov et al., "A new class of antivirals: antisense oligonucleotides combined with a hydrophobic substituent effectively inhibit influenza virus reproduction and synthesis of virus-specific proteins in MDCK cells" FEBS Lett. (1990) 259:327-330.
King et al., "Topoisomerases facilitate transcription of long genes linked to autism" Nature (2013) 501: 58-62.
Koch et al., "Quantum Mechanical Studies of DNA and LNA" Nucl Acid Therap (2014) 24: 139-148.
Koshkin et al., "LNA (locked nucleic acids): Synthesis of the adenine, cytosine, guanine, 5-methylcytosine, thymine and uracil bicyclonucleoside monomers, oligomerisation, and unprecedented nucleic acid recognition" Tetrahedron (1998) 54:3607-3630.
Kumar et al., "The first analogues of LNA (locked nucleic acids): phosphorothioate-LNA and 2'-thio-LNA" Bioorg Med Chem Lett. (1998) 8:2219-2222.
Letsinger et al., "Cholesteryl-conjugated oligonucleotides: Synthesis, properties, and activity as inhibitors of replication of human immunodeficiency virus in cell culture" PNAS (1989) 86:6553-6556.
Leumann et al., "DNA Analogues: From Supramolecular Principles to Biological Properties" Bioorganic & Medicinal Chemistry (2002) 10:841-854.
Luo et al., "A Ribonucleolytic Rat Torpedoes RNA Polymerase II" Cell (2004) 119: 911-914.
Maher et al., "Comparative hybrid arrest by tandem antisense oligodeoxyribonucleotides or oligodeoxyribonucleoside methylpbosphonates in a cell-free system" Nucl. Acid. Res. (1988) 16(8):3341-3358.
Manoharan et al., "Chemical Modifications to Improve Uptake and Bioavailability of Antisense Oligonucleotides" Ann. N.Y. Acad. Sci. (1992) 660: 306-309.
Manoharan et al., "Cholic Acid-Oligonucleotide Conjugates for Antisense Applications" Bioorg. Med. Chem. Lett. (1994) 4:1053-1060.
Manoharan et al., "Introduction of a Lipophilic Thioether Tether in the Minor Groove of Nucleic Acids for Antisense Applications" Bioorg. Med. Chem. Lett. (1993) 3(12):2765-2770.
Manoharan et al., "Lipidic Nucleic Acids" Tetrahedron Lett. (1995) 36(21):3651-3654.
Manoharan et al., "Oligonucleotide Conjugates: Alteration of the Pharmacokinetic Properties of Antisense Agents" Nucleosides & Nucleotides (1995) 14(3-5):969-973.
Martin, "New acces to 2'-O-alkylated ribonucleosides and properties of 2'-O-alkylated oligoribonucleotides" Helv. Chim. Acta. (1995) 78:486-504.
Meng et al., "Ube3a-ATS is an atypical RNA polymerase II transcript that represses the paternal expression of Ube3a" Hum. Mol. Genet. (2012) 21(13):3001-3012.
Meng et al., "Towards a therapy for Angelman Syndrome by Targeting a long-coding RNA" Nature (2015) 518:409-412.
Meng et al.,"Truncation of Ube3a-ATS Unsilences Paternal UBE3A and Ameliorates Behavioral Defects in the Angelman Syndrome Mouse Model" PLOS Genetics (2013) 9:e1004039.
Miller et al., "Phenotypic characterization of a genetically diverse panel of mice for behavioral despair and anxiety" PLoS One (2010) 5(12):e14458.
Mishra et al., "Improved leishmanicidal effect of phosphorotioate antisense oligonucleotides by LDL-mediated delivery" Biochim. Biophys. Acta (1995) 1264:229-237.
Modarresi et al., "Inhibition of natural antisense transcripts in vivo results in gene-specific transcriptional upregulation" Nat. Biotechnol. (2012) 30(5):453-459.
Modarresi et al., "Inhibition of natural antisense transcripts in vivo results in gene-specific transcriptional upregulation" Nat. Biotechnol. (2012) 30(5) Supporting Materials.
Morris et al., "Bidirectional transcription directs both transcriptional gene activation and suppression in human cells" PLoS Genet. (2008) 4(11):e1000258.
Nauwelaerts et al., "Cyclohexenyl nucleic acids: conformationally flexible oligonucleotides" Nucleic Acids Res. (2005) 33(8):2452-2463.
Nauwelaerts et al., "Structural characterization and biological evaluation of small interfering RNAs containing cyclohexenyl nucleosides" J. Am. Chem. Soc. (2007) 129(30):9340-9348.
New England Biolabs 1998/99 Catalog (cover page and pp. 121 and 284).
Njung'e et al., "Evaluation of marble-burying behavior as a model of anxiety" Pharmacol. Biochem. Behav. (1991) 38(1):63-67.
Oberhauser et al., "Effective incorporation of 2'-O-methyl-oligoribonucleotides into liposomes and enhanced cell association through modifications with thiocholesterol" Nucl. Acids Res. (1992) 20(3):533-538.
Orum et al., "Locked nucleic acids: A promising molecular family for gene-function analysis and antisense drug development" Curr. Opinion Mol. Ther. (2001) 3:239-243.
Pal-Bhadra et al., "Heterochromatic silencing and HP1 localization in Drosophila are dependent on the RNAi machinery" Science (2004) 303(5658):669-672.
Papargyri et al., "Chemical Diversity of Locked Nucleic Acid-Modified Antisense Oligonucleotides Allows Optimization of Pharmaceutical Properties" Mol Ther Nuclic Acids (2020) 19: 706-717.
Plagge "Non-Coding RNAs at the Gnas and Snrpn-Ube3a Imprinted Gene Loci and Their Involvement in Hereditary Disorders" Front Genet. (2012) 3: 1-6.
Philpot et al., "Angelman syndrome: advancing the research frontier of neurodevelopment disorders" J Neurodevelop Disord (2011) 3: 50-56.
Powell et al., "R-loop formation at Snord116 mediates topotecan inhibition of Ube3a-antisense and allele-specific chromatin decondensation" Proc Natl Acad Sci (2013) 110: 13938-43.
Reynolds et al., "Rational siRNA design for RNA interference" Nature Biotechnology (2004) 22(3):326-330.
Robeyns et al., "Oligonucleotides with cyclohexene-nucleoside building blocks: crystallization and preliminary X-ray studies of a

(56) References Cited

OTHER PUBLICATIONS left-handed sequence GTGTACAC" Acta. Crystallogr. Sect. F. Struct. Biol. Cryst. Commun. (2005) 61(Pt 6):585-586.
Robeyns et al., "Structure of the fully modified left-handed cyclohexene nucleic acid sequence GTGTACAC" J. Am. Chem. Soc. (2008) 130(6):1979-1984.
Rougeulle et al. "An imprinted antisense RNA overlaps UBE3A and a second maternally expressed transcript" Nature Genet (1998) 19: 15-16.
Rougeulle et al., "The Angelman syndrome candidate gene, UBE3A/E6-AP, is imprinted in brain" Nature Generics (1997) 17: 14-15.
Runte et al., "The IC-SNURF-SNRPN Transcript serves as a Host for Multiple Small Nucleolar RNA Species and as an Antisense RNA for UBE3A" Human Molecular Genetics (2001) 10: 2687-2700.
Sahoo et al., "Prader-Willi phenotype caused by paternal deficiency for the HBII-85 C/D box small nucleolar RNA cluster" Nat. Genet. (2008) 40(6):719-721.
Saison-Behmoaras et al., "Short modified antisense oligonucleotides directed against Ha-ras point mutation induce selective cleavage of the mRNA and inhibit T24 cells proliferation" EMBO J. (1991) 10(5):1111-1118.
Sanghvi et al., "Heterocyclic Base Modifications in Nucleic Acids and Their Applications in Antisense Oligonucleotides" Antisense Research and Applications (1993) pp. 273-288.
Seth et al., "Short Antisense Oligonucleotides with Novel 2'-4' Conformationaly Restricted Nucleoside Analogues Show Improved Potency Without Increased Toxicity in Animals." J Med Chem (2009) 52:10-13.
Shea et al., "Synthesis, hybridization properties and antiviral activity of lipid-oligodeoxynucleotide conjugates" Nucl. Acids Res. (1990) 18(13):3777-3783.
Shi et al., "In situ entry of oligonucleotides into brain cells can occur through a nucleic acid channel" Oligonucleotides (2007) 17: 122-133.
Singh et al., "LNA (locked nucleic acids): synthesis and high-affinity nucleic acid recognition" Chem. Commun. (1998) 455-456.
Singh et al., "Synthesis of 2'-amino-LNA: A novel conformationally restricted high-affinity oligonucleotide analogue with a handle" J. Org. Chem. (1998)63: 10035-10039.
Smith et al., "Comparison of biosequences" Adv. Appl. Math. (1981) 2(4):482-489.
Smith et al., "Transcription is Required to Establish Maternal Imprinting at the Prader-Willi Syndrome and Angelman Syndrome Locus" PLoS Genetics (2011) 7: 1-10.
Srivastava et al., "Five- and Six-Membered Conformationally Locked 2',4'-Carbocyclic ribo-Thymidines: Synthesis, Structure, and Biochemical Studies" J. Am. Chem. Soc. (2007) 129(26):8362-8379.
Svinarchuk et al., "Inhibition of HIV proliferation in MT-4 cells by antisense oligonucleotide conjugated to lipophilic groups" Biochimie (1993) 75:49-54.
Tsai et al., "Paternal deletion from Snrpn to Ube3a in the mouse causes hypotonia, growth retardation and partial lethality and provides evidence for a gene contributing to Prader-Willi syndrome" Hum. Mol. Genet. (1999) 8(8):1357-1364.
Verbeure et al., "RNase H mediated cleavage of RNA by cyclohexene nucleic acid (CeNA)" Nucleic Acids Res. (2001) 29(24):4941-4947.
Verdel et al., "RNAi-mediated targeting of heterochromatin by the RITS complex" Science (2004) 303(5668):672-676.
Volpe et al., "Regulation of heterochromatic silencing and histone H3 lysine-9 methylation by RNAi" Science (2002) 297(5588):1833:1837.
Wahlestedt et al., "Potent and nontoxic antisense oligonucleotide containing locked nucleic acids" Proc. Natl. Acad. Sci. USA (2000) 97: 5633-5638.
Wahlestedt et al., "Natural antisense and noncoding RNA transcripts as potential drug targets" Drug Discovery Today (2006) 11: 503-508.
Wahlestedt et al., "Regulatory Natural Antisense Transcripts" Keystone Symposium on MicroRNAs and Human Disease: Banff, Alberta CA (Feb. 11-16, 2011).
Wahlestedt et al., "Regulatory Natural Antisense Transcripts" Keystone Symposium Programme: Banff, Alberta CA (Feb. 11-16, 2011).
Wang et al., "A straightforward stereoselective synthesis of D- and L-5-hydroxy-4-hydroxymethyl-2-cyclohexenylguanine" J. Org. Chem. (2001) 66(25):8478-8482.
Wang et al., "Cyclohexene nucleic acids (CeNA) form stable duplexes with RNA and induce RNase H activity" Nucleosides Nucleotides Nucleic Acids (2001) 20(4-7):785-788.
Wang et al., "Cyclohexene Nucleic Acids (CeNA): Serum Stable Oligonucleotides that Activate RNase H and Increase Duplex Stability with Complementary RNA" J. Am. Chem. Soc. (2000) 122(36):8595-8602.
Wang et al., "Stereocontrolled synthesis of ara-type cyclohexenyl nucleosides" J. Org. Chem. (2003) 68(11):4499-4505.
Williams et al., "Clinical and genetic aspects of Angelman syndrome" Genet. Med. (2010) 12(7):385-395.
Woolf et al., "Specificity of antisense oligonucleotides in vivo" Proc. Natl. Acad. Sci. (1992) 89(16):7305-7309.
Zhang et al., "PowerBLAST: A New Network BLAST Application for Interactive or Automated Sequence Analysis and Annotation" Genome Res. (1997) 7:649-656.
Zhou et al., "Fine Tuning of Electrostatics around the Internucleotidic Phosphate through Incorporation of Modified 2',4'-Carbocyclic-LNAs and -ENAs Leads to Significant Modulation of Antisense Properties" J. Org. Chem. (2009) 74:118-134.
International Search report for application EP 2864479 dated May 10, 2016.
International Search Report for application PCT/US2013/47701 dated Feb. 14, 2014.
International Search Report for application PCT/US2015/062622 dated Jan. 15, 2016.
International Search Report for application PCT/US20/025110 dated Aug. 19, 2020.

COMPOUNDS AND METHODS FOR MODULATING UBE3A-ATS

SEQUENCE LISTING

The present application is being filed along with a Sequence Listing in electronic format. The Sequence Listing is provided as a file entitled BIOL0349USC1SEQ_ST25.txt, created on Apr. 16, 2021, which is 1.87 MB in size. The information in the electronic format of the sequence listing is incorporated herein by reference in its entirety.

FIELD

Provided are compounds, methods, and pharmaceutical compositions for reducing the amount or activity of UBE3A-ATS, the endogenous antisense transcript of ubiquitin protein ligase E3A (UBE3A) in a cell or subject, and in certain instances increasing the expression of paternal UBE3A and the amount of UBE3A protein in a cell or subject. Such compounds, methods, and pharmaceutical compositions are useful to ameliorate at least one symptom or hallmark of a neurogenetic disorder. Such symptoms and hallmarks include developmental delays, ataxia, speech impairment, sleep problems, seizures, and EEG abnormalities. Such neurogenetic disorders include Angelman Syndrome.

BACKGROUND

Angelman Syndrome (AS) is a developmental disorder that affects ~1/15,000 live births and is caused by a deficiency of ubiquitin protein ligase E3A (UBE3A). Of the two copies of the UBE3A gene in neurons, the maternal gene is typically expressed, while the paternal gene is subject to genetic imprinting and silencing. Angelman Syndrome is caused when a functional copy of the UBE3A gene is not inherited from the mother, either because of a mutation, a deletion, paternal uniparental disomy of chromosome 15, or an imprinting defect. See, Buiting, et al., "Angelman Syndrome—insights into a rare neurogenetic disorder", Nature Rev. Neuro., 2016, 12:584-593.

Angelman Syndrome patients experience developmental delays and speech impairment, and commonly experience sleep problems, seizures, and EEG abnormalities. The disorder is usually diagnosed in the first few years of life and the diagnosis can be confirmed by genetic testing. However, therapies for Angelman Syndrome remain limited and focus mainly on symptomatic management. See, Williams, C. A. et al., Genet. Med., 12: 385-395, 2010.

Recently, topoisomerase inhibitors currently used in cancer treatment were found to "unsilence" paternal UBE3A expression in both a neuronal culture system and mice. See, Huang, H. S. et al., Nature, 481: 185-189, 2012. However, the exact mechanism of unsilencing paternal UBE3A expression remains unknown and topoisomerase inhibitors are fraught with safety concerns because they are known to be non-specific and capable of inducing DNA damage, such as single and double-strand breaks.

Currently there is a lack of acceptable options for treating neurogenetic disorders such as AS. It is therefore an object herein to provide compounds, methods, and pharmaceutical compositions for the treatment of such diseases.

SUMMARY OF THE INVENTION

Provided herein are compounds, methods and pharmaceutical compositions for reducing the amount or activity of UBE3A-ATS RNA, and in certain embodiments increasing the expression of paternal UBE3A RNA or protein in a cell or subject. In certain embodiments, the subject has a neurogenetic disorder. In certain embodiments, the subject has Angelman Syndrome (AS). In certain embodiments, compounds useful for reducing expression of UBE3A-ATS RNA, or a portion thereof, are oligomeric compounds. In certain embodiments, compounds useful for reducing expression of UBE3A-ATS RNA, or a portion thereof, are modified oligonucleotides. In certain embodiments, compounds useful for increasing expression of paternal UBE3A RNA or protein are oligomeric compounds In certain embodiments, compounds useful for increasing expression of paternal UBE3A RNA or protein are modified oligonucleotides.

Also provided are methods useful for ameliorating at least one symptom or hallmark of a neurogenetic disorder. In certain embodiments, the neurogenetic disorder is Angelman Syndrome. In certain embodiments, the symptom or hallmark includes developmental delays, ataxia, speech impairment, sleep problems, seizures, and/or EEG abnormalities.

DETAILED DESCRIPTION OF THE INVENTION

It is to be understood that both the foregoing general description and the following detailed description are exemplary and explanatory only and are not restrictive. Herein, the use of the singular includes the plural unless specifically stated otherwise. As used herein, the use of "or" means "and/or" unless stated otherwise. Furthermore, the use of the term "including" as well as other forms, such as "includes" and "included", is not limiting. Also, terms such as "element" or "component" encompass both elements and components comprising one unit and elements and components that comprise more than one subunit, unless specifically stated otherwise.

The section headings used herein are for organizational purposes only and are not to be construed as limiting the subject matter described. All documents, or portions of documents, cited in this application, including, but not limited to, patents, patent applications, articles, books, and treatises, are hereby expressly incorporated-by-reference for the portions of the document discussed herein, as well as in their entirety.

Definitions

Unless specific definitions are provided, the nomenclature used in connection with, and the procedures and techniques of, analytical chemistry, synthetic organic chemistry, and medicinal and pharmaceutical chemistry described herein are those well-known and commonly used in the art. Where permitted, all patents, applications, published applications and other publications and other data referred to throughout in the disclosure are incorporated by reference herein in their entirety.

Unless otherwise indicated, the following terms have the following meanings:

Definitions

As used herein, "2'-deoxynucleoside" means a nucleoside comprising a 2'-H(H) deoxyribosyl sugar moiety. In certain embodiments, a 2'-deoxynucleoside is a 2'-β-D-deoxynucleoside and comprises a 2'-β-D-deoxyribosyl sugar moiety, which has the β-D configuration as found in naturally occurring deoxyribonucleic acids (DNA). In certain embodiments, a 2'-deoxynucleoside may comprise a modified nucleobase or may comprise an RNA nucleobase (uracil).

As used herein, "2'-MOE" or "2'-MOE sugar moiety" means a 2'-OCH$_2$CH$_2$OCH$_3$ group in place of the 2'-OH group of a ribosyl sugar moiety. "MOE" means methoxyethyl. Unless otherwise indicated, a 2'-MOE has the β-D stereochemical configuration.

As used herein, "2'-MOE nucleoside" means a nucleoside comprising a 2'-MOE sugar moiety.

As used herein, "2'-OMe" or "2'-O-methyl sugar moiety" means a 2'-OCH$_3$ group in place of the 2'-OH group of a ribosyl sugar moiety. Unless otherwise indicated, a 2'-OMe has the β-D stereochemical configuration.

As used herein, "2'-OMe nucleoside" means a nucleoside comprising a 2'-OMe sugar moiety.

As used herein, "2'-substituted nucleoside" means a nucleoside comprising a 2'-substituted sugar moiety. As used herein, "2'-substituted" in reference to a sugar moiety means a sugar moiety comprising at least one 2$^1$-substituent group other than H or OH.

As used herein, "5-methyl cytosine" means a cytosine modified with a methyl group attached to the 5 position. A 5-methyl cytosine is a modified nucleobase.

As used herein, "administering" means providing a pharmaceutical agent to a subject.

As used herein, "antisense activity" means any detectable and/or measurable change attributable to the hybridization of an antisense compound to its target nucleic acid. In certain embodiments, antisense activity is a decrease in the amount or expression of a target nucleic acid or protein encoded by such target nucleic acid compared to target nucleic acid levels or target protein levels in the absence of the antisense compound.

As used herein, "antisense compound" means an oligomeric compound capable of achieving at least one antisense activity.

As used herein, "ameliorate" in reference to a treatment means improvement in at least one symptom relative to the same symptom in the absence of the treatment. In certain embodiments, amelioration is the reduction in the severity or frequency of a symptom or the delayed onset or slowing of progression in the severity or frequency of a symptom. In certain embodiments, the symptom or hallmark is developmental delays, ataxia, speech impairment, sleep problems, seizures, and EEG abnormalities.

As used herein, "bicyclic nucleoside" or "BNA" means a nucleoside comprising a bicyclic sugar moiety.

As used herein, "bicyclic sugar" or "bicyclic sugar moiety" means a modified sugar moiety comprising two rings, wherein the second ring is formed via a bridge connecting two of the atoms thereby forming a bicyclic structure. In certain embodiments, the first ring of the bicyclic sugar moiety is a furanosyl moiety. In certain embodiments, the bicyclic sugar moiety does not comprise a furanosyl moiety.

As used herein, "cleavable moiety" means a bond or group of atoms that is cleaved under physiological conditions, for example, inside a cell, a subject, or a human.

As used herein, "complementary" in reference to an oligonucleotide means that at least 70% of the nucleobases of the oligonucleotide or one or more portions thereof and the nucleobases of a target nucleic acid or one or more portions thereof are capable of hydrogen bonding with one another when the nucleobase sequence of the oligonucleotide and the other nucleic acid are aligned in opposing directions. As used herein, complementary nucleobases means nucleobases that are capable of forming hydrogen bonds with one another. Complementary nucleobase pairs include adenine (A) and thymine (T), adenine (A) and uracil (U), cytosine (C) and guanine (G), 5-methyl cytosine (mC) and guanine (G). Complementary oligonucleotides and/or target nucleic acids need not have nucleobase complementarity at each nucleoside. Rather, some mismatches are tolerated. As used herein, "fully complementary" or "100% complementary" in reference to an oligonucleotide, or portion thereof, means that the oligonucleotide, or portion thereof, is complementary to another oligonucleotide or target nucleic acid at each nucleobase of the shorter of the two oligonucleotides, or at each nucleoside if the oligonucleotides are the same length.

As used herein, "conjugate group" means a group of atoms that is directly or indirectly attached to an oligonucleotide. Conjugate groups include a conjugate moiety and a conjugate linker that attaches the conjugate moiety to the oligonucleotide.

As used herein, "conjugate linker" means a single bond or a group of atoms comprising at least one bond that connects a conjugate moiety to an oligonucleotide.

As used herein, "conjugate moiety" means a group of atoms that is attached to an oligonucleotide via a conjugate linker.

As used herein, "contiguous" in the context of an oligonucleotide refers to nucleosides, nucleobases, sugar moieties, or internucleoside linkages that are immediately adjacent to each other. For example, "contiguous nucleobases" means nucleobases that are immediately adjacent to each other in a sequence.

As used herein, "constrained ethyl" or "cEt" or "cEt modified sugar moiety" means a β-D ribosyl bicyclic sugar moiety wherein the second ring of the bicyclic sugar is formed via a bridge connecting the 4'-carbon and the 2'-carbon of the β-D ribosyl sugar moiety, wherein the bridge has the formula 4'-CH(CH$_3$)—O-2', and wherein the methyl group of the bridge is in the S configuration.

As used herein, "cEt nucleoside" means a nucleoside comprising a cEt modified sugar moiety.

As used herein, "chirally enriched population" means a plurality of molecules of identical molecular formula, wherein the number or percentage of molecules within the population that contain a particular stereochemical configuration at a particular chiral center is greater than the number or percentage of molecules expected to contain the same particular stereochemical configuration at the same particular chiral center within the population if the particular chiral center were stereorandom. Chirally enriched populations of molecules having multiple chiral centers within each molecule may contain one or more stereorandom chiral centers. In certain embodiments, the molecules are modified oligonucleotides. In certain embodiments, the molecules are compounds comprising modified oligonucleotides.

As used herein, "gapmer" means a modified oligonucleotide comprising an internal region having a plurality of nucleosides that support RNase H cleavage positioned between external regions having one or more nucleosides, wherein the nucleosides comprising the internal region are chemically distinct from the nucleoside or nucleosides comprising the external regions. The internal region may be referred to as the "gap" and the external regions may be referred to as the "wings." Unless otherwise indicated, "gapmer" refers to a sugar motif. Unless otherwise indicated, the sugar moiety of each nucleoside of the gap is a 2'-β-D-deoxyribosyl sugar moiety. Thus, the term "MOE gapmer" indicates a gapmer having a gap comprising 2'-β-D-deoxynucleosides and wings comprising 2'-MOE nucleosides. Unless otherwise indicated, a MOE gapmer may comprise one or more modified internucleoside linkages and/or modified nucleobases and such modifications do not necessarily follow the gapmer pattern of the sugar modifications.

As used herein, "hotspot region" is a range of nucleobases on a target nucleic acid that is amenable to oligomeric compound-mediated reduction of the amount or activity of the target nucleic acid.

As used herein, "hybridization" means the pairing or annealing of complementary oligonucleotides and/or nucleic acids. While not limited to a particular mechanism, the most common mechanism of hybridization involves hydrogen bonding, which may be Watson-Crick, Hoogsteen or reversed Hoogsteen hydrogen bonding, between complementary nucleobases.

As used herein, "internucleoside linkage" means the covalent linkage between contiguous nucleosides in an oligonucleotide. As used herein, "modified internucleoside linkage" means any internucleoside linkage other than a phosphodiester internucleoside linkage. "Phosphorothioate internucleoside linkage" is a modified internucleoside linkage in which one of the non-bridging oxygen atoms of a phosphodiester internucleoside linkage is replaced with a sulfur atom.

As used herein, "linker-nucleoside" means a nucleoside that links, either directly or indirectly, an oligonucleotide to a conjugate moiety. Linker-nucleosides are located within the conjugate linker of an oligomeric compound. Linker-nucleosides are not considered part of the oligonucleotide portion of an oligomeric compound even if they are contiguous with the oligonucleotide.

As used herein, "non-bicyclic modified sugar moiety" means a modified sugar moiety that comprises a modification, such as a substituent, that does not form a bridge between two atoms of the sugar to form a second ring.

As used herein, "mismatch" or "non-complementary" means a nucleobase of a first oligonucleotide that is not complementary with the corresponding nucleobase of a second oligonucleotide or target nucleic acid when the first and second oligonucleotide are aligned.

As used herein, "motif" means the pattern of unmodified and/or modified sugar moieties, nucleobases, and/or internucleoside linkages, in an oligonucleotide.

As used herein, "neurogenetic disorder" means a condition of the nervous system caused by a heritable genetic factor, including, but not limited to, a mutation, a deletion, uniparental disomy, or an imprinting defect.

As used herein, "nucleobase" means an unmodified nucleobase or a modified nucleobase. As used herein an "unmodified nucleobase" is adenine (A), thymine (T), cytosine (C), uracil (U), or guanine (G). As used herein, a "modified nucleobase" is a group of atoms other than unmodified A, T, C, U, or G capable of pairing with at least one unmodified nucleobase. A "5-methyl cytosine" is a modified nucleobase. A universal base is a modified nucleobase that can pair with any one of the five unmodified nucleobases. As used herein, "nucleobase sequence" means the order of contiguous nucleobases in a target nucleic acid or oligonucleotide independent of any sugar or internucleoside linkage modification.

As used herein, "nucleoside" means a compound comprising a nucleobase and a sugar moiety. The nucleobase and sugar moiety are each, independently, unmodified or modified. As used herein, "modified nucleoside" means a nucleoside comprising a modified nucleobase and/or a modified sugar moiety. Modified nucleosides include abasic nucleosides, which lack a nucleobase. "Linked nucleosides" are nucleosides that are connected in a contiguous sequence (i.e., no additional nucleosides are presented between those that are linked).

As used herein, "oligomeric compound" means an oligonucleotide and optionally one or more additional features, such as a conjugate group or terminal group. An oligomeric compound may be paired with a second oligomeric compound that is complementary to the first oligomeric compound or may be unpaired. A "singled-stranded oligomeric compound" is an unpaired oligomeric compound. The term "oligomeric duplex" means a duplex formed by two oligomeric compounds having complementary nucleobase sequences. Each oligomeric compound of an oligomeric duplex may be referred to as a "duplexed oligomeric compound."

As used herein, "oligonucleotide" means a strand of linked nucleosides connected via internucleoside linkages, wherein each nucleoside and internucleoside linkage may be modified or unmodified. Unless otherwise indicated, oligonucleotides consist of 8-50 linked nucleosides. As used herein, "modified oligonucleotide" means an oligonucleotide, wherein at least one nucleoside or internucleoside linkage is modified. As used herein, "unmodified oligonucleotide" means an oligonucleotide that does not comprise any nucleoside modifications or internucleoside modifications.

As used herein, "pharmaceutically acceptable carrier or diluent" means any substance suitable for use in administering to a subject. Certain such carriers enable pharmaceutical compositions to be formulated as, for example, tablets, pills, dragees, capsules, liquids, gels, syrups, slurries, suspension and lozenges for the oral ingestion by a subject. In certain embodiments, a pharmaceutically acceptable carrier or diluent is sterile water, sterile saline, sterile buffer solution or sterile artificial cerebrospinal fluid.

As used herein, "pharmaceutically acceptable salts" means physiologically and pharmaceutically acceptable salts of compounds. Pharmaceutically acceptable salts retain the desired biological activity of the parent compound and do not impart undesired toxicological effects thereto.

As used herein, "pharmaceutical composition" means a mixture of substances suitable for administering to a subject. For example, a pharmaceutical composition may comprise an oligomeric compound and a sterile aqueous solution. In certain embodiments, a pharmaceutical composition shows activity in free uptake assay in certain cell lines.

As used herein, "prodrug" means a therapeutic agent in a form outside the body that is converted to a different form within a subject or cells thereof. Typically, conversion of a prodrug within the subject is facilitated by the action of an enzymes (e.g., endogenous or viral enzyme) or chemicals present in cells or tissues and/or by physiologic conditions.

As used herein, "reducing or inhibiting the amount or activity", "reducing the amount or activity", or "inhibiting the amount or activity" refers to a reduction or blockade of the transcriptional expression or activity relative to the transcriptional expression or activity in an untreated or control sample and does not necessarily indicate a total elimination of transcriptional expression or activity.

As used herein, "RNA" means any RNA transcript, including endogenous antisense transcripts that do not encode a protein (e.g., UBE3A-ATS), and also includes pre-mRNA and mature mRNA unless otherwise specified.

As used herein, "$RNAJ_1$ compound" means an antisense compound that acts, at least in part, through RISC or Ago2 to modulate a target nucleic acid and/or protein encoded by a target nucleic acid. $RNAJ_1$ compounds include, but are not limited to double-stranded siRNA, single-stranded RNA (ssRNA), and microRNA, including microRNA mimics In certain embodiments, an $RNAJ_1$ compound modulates the amount, activity, and/or splicing of a target nucleic acid. The term $RNAJ_1$ compound excludes antisense compounds that act through RNase H.

As used herein, "self-complementary" in reference to an oligonucleotide means an oligonucleotide that at least partially hybridizes to itself.

As used herein, "standard cell assay" means the assay described in Example 1 and reasonable variations thereof.

As used herein, "stereorandom chiral center" in the context of a population of molecules of identical molecular formula means a chiral center having a random stereochemical configuration. For example, in a population of molecules comprising a stereorandom chiral center, the number of molecules having the (S) configuration of the stereorandom chiral center may be but is not necessarily the same as the number of molecules having the (R) configuration of the stereorandom chiral center. The stereochemical configuration of a chiral center is considered random when it is the result of a synthetic method that is not designed to control the stereochemical configuration. In certain embodiments, a stereorandom chiral center is a stereorandom phosphorothioate internucleoside linkage.

As used herein, "subject" means a human or non-human animal

As used herein, "sugar moiety" means an unmodified sugar moiety or a modified sugar moiety. As used herein, "unmodified sugar moiety" means a 2'-OH(H) β-D-ribosyl moiety, as found in RNA (an "unmodified RNA sugar moiety"), or a 2'-H(H) β-D-deoxyribosyl sugar moiety, as found in DNA (an "unmodified DNA sugar moiety"). Unmodified sugar moieties have one hydrogen at each of the 1', 3', and 4' positions, an oxygen at the 3' position, and two hydrogens at the 5' position. As used herein, "modified sugar moiety" or "modified sugar" means a modified furanosyl sugar moiety or a sugar surrogate.

As used herein, "sugar surrogate" means a modified sugar moiety having other than a furanosyl moiety that can link a nucleobase to another group, such as an internucleoside linkage, conjugate group, or terminal group in an oligonucleotide. Modified nucleosides comprising sugar surrogates can be incorporated into one or more positions within an oligonucleotide and such oligonucleotides are capable of hybridizing to complementary oligomeric compounds or target nucleic acids.

As used herein, "symptom or hallmark" means any physical feature or test result that indicates the existence or extent of a disease or disorder. In certain embodiments, a symptom is apparent to a subject or to a medical professional examining or testing said subject. In certain embodiments, a hallmark is apparent upon invasive diagnostic testing, including, but not limited to, post-mortem tests.

As used herein, "target nucleic acid" and "target RNA" mean a nucleic acid that an antisense compound is designed to affect.

As used herein, "target region" means a portion of a target nucleic acid to which an oligomeric compound is designed to hybridize.

As used herein, "terminal group" means a chemical group or group of atoms that is covalently linked to a terminus of an oligonucleotide.

As used herein, "therapeutically effective amount" means an amount of a pharmaceutical agent that provides a therapeutic benefit to a subject. For example, a therapeutically effective amount improves a symptom or hallmark of a disease.

CERTAIN EMBODIMENTS

The Present Disclosure Provides the Following Non-Limiting Numbered Embodiments:

Embodiment 1. An oligomeric compound comprising a modified oligonucleotide consisting of 12 to 30 linked nucleosides wherein the nucleobase sequence of the modified oligonucleotide is at least 90% complementary to an equal length portion of a UBE3A-ATS RNA, and wherein the modified oligonucleotide comprises at least one modification selected from a modified sugar moiety and a modified internucleoside linkage.

Embodiment 2. An oligomeric compound comprising a modified oligonucleotide consisting of 12 to 30 linked nucleosides and having a nucleobase sequence comprising at least 12, 13, 14, 15, 16, 17, 18, 19, or 20 contiguous nucleobases of any of SEQ ID NOs: 17-2762, 2786-2863, 2872-2904.

Embodiment 3. An oligomeric compound comprising a modified oligonucleotide consisting of 12 to 30 linked nucleosides and having a nucleobase sequence comprising at least 12, 13, 14, 15, 16, 17, or 18 contiguous nucleobases of any of SEQ ID NOs: 2763-2785 or 2864-2871.

Embodiment 4. An oligomeric compound comprising a modified oligonucleotide consisting of 12 to 30 linked nucleosides and having a nucleobase sequence comprising at least 8, at least 9, at least 10, at least 11, at least 12, at least 13, at least 14, at least 15, at least 16, at least 17, at least 18, at least 19, or at least 20 contiguous nucleobases complementary to:

an equal length portion of nucleobases 461,413-461,487 of SEQ ID NO: 1;

an equal length portion of nucleobases 468,968-469,013 of SEQ ID NO: 1; or an equal length portion of nucleobases 483,965-484,003 of SEQ ID NO: 1

Embodiment 5. An oligomeric compound comprising a modified oligonucleotide consisting of 12 to 30 linked nucleosides and having a nucleobase sequence comprising at least 8, at least 9, at least 10, at least 11, at least 12, at least 13, at least 14, at least 15, at least 16, at least 17, or at least 18 contiguous nucleobases of a sequence selected from:

SEQ ID Nos:1053, 1329, 1501, 1576, 1873, 1949, 2025, 2096, 2245, 2512,2591,2680-2682, and 2844;

SEQ ID Nos: 376, 377, 2751-2756, 2773-2776, 2872, 2873, 2876-2878; or

SEQ ID Nos: 172, 764-770, 995, 1445, 1668, 1743, 2255, 2595, 2762-2767.

Embodiment 6. The oligomeric compound of any of embodiments 1-5, wherein the modified oligonucleotide has a nucleobase sequence that is at least 80%, 85%, 90%, 95%, or 100% complementary to the nucleobase sequence of SEQ ID NO: 1, SEQ ID NO: 2915, or SEQ ID NO: 2916 when measured across the entire nucleobase sequence of the modified oligonucleotide.

Embodiment 7. The oligomeric compound of any of embodiments 1-6, wherein the modified oligonucleotide comprises at least one modified nucleoside.

Embodiment 8. The oligomeric compound of embodiment 7, wherein the modified oligonucleotide comprises at least one modified nucleoside comprising a modified sugar moiety.

Embodiment 9. The oligomeric compound of embodiment 8, wherein the modified oligonucleotide comprises at least one modified nucleoside comprising a bicyclic sugar moiety.

Embodiment 10. The oligomeric compound of embodiment 9, wherein the modified oligonucleotide comprises at least one modified nucleoside comprising a bicyclic sugar moiety having a 2'-4' bridge, wherein the 2'-4' bridge is selected from —O—CH$_2$—; and —O—CH(CH$_3$)—.

Embodiment 11. The oligomeric compound of any of embodiments 7-10, wherein the modified oligonucleotide comprises at least one modified nucleoside comprising a non-bicyclic modified sugar moiety.

Embodiment 12. The oligomeric compound of embodiment 11, wherein the non-bicyclic modified sugar moiety is a 2'-MOE modified sugar moiety or 2'-OMe modified sugar moiety.

Embodiment 13. The oligomeric compound of any of embodiments 7-8, wherein the modified oligonucleotide comprises at least one modified nucleoside comprising a sugar surrogate.

Embodiment 14. The oligomeric compound of embodiment 13, wherein the modified oligonucleotide comprises at least one modified nucleoside comprising a sugar surrogate selected from morpholino and PNA.

Embodiment 15. The oligomeric compound of any of embodiments 1-8 or 11-14, wherein the modified oligonucleotide does not comprise a bicyclic sugar moiety.

Embodiment 16. The oligomeric compound of any of embodiments 1-15, wherein the modified oligonucleotide is a gapmer.

Embodiment 17. The oligomeric compound of any of embodiments 1-16, wherein the modified oligonucleotide has a sugar motif comprising:

a 5'-region consisting of 1-6 linked 5'-region nucleosides;
a central region consisting of 6-10 linked central region nucleosides; and
a 3'-region consisting of 1-6 linked 3'-region nucleosides;
wherein each of the 5'-region nucleosides and each of the 3'-region nucleosides comprises a modified sugar moiety and each of the central region nucleosides comprises a 2'-β-D-deoxyribosyl sugar moiety.

Embodiment 18. The oligomeric compound of embodiment 17, wherein the modified oligonucleotide has a 5'-region consisting of 5 linked 5'-region nucleosides;
a central region consisting of 10 linked central region nucleosides; and
a 3'-region consisting of 5 linked 3'-region nucleosides;
wherein each of the 5'-region nucleosides and each of the 3'-region nucleosides comprises a 2'-MOE modified sugar moiety, and each of the central region nucleosides comprises a 2'-β-D-deoxyribosyl sugar moiety.

Embodiment 19. The oligomeric compound of embodiment 17, wherein the modified oligonucleotide has a 5'-region consisting of 4 linked 5'-region nucleosides;
a central region consisting of 10 linked central region nucleosides; and
a 3'-region consisting of 6 linked 3'-region nucleosides;
wherein each of the 5'-region nucleosides and each of the 3'-region nucleosides a 2'-MOE modified sugar moiety, and each of the central region nucleosides comprises a 2'-β-D-deoxyribosyl sugar moiety.

Embodiment 20. The oligomeric compound of embodiment 17, wherein the modified oligonucleotide has a 5'-region consisting of 6 linked 5'-region nucleosides;
a central region consisting of 10 linked central region nucleosides; and
a 3'-region consisting of 4 linked 3'-region nucleosides;
wherein each of the 5'-region nucleosides and each of the 3'-region nucleosides a 2'-MOE modified sugar moiety, and each of the central region nucleosides comprises a 2'-β-D-deoxyribosyl sugar moiety.

Embodiment 21. The oligomeric compound of embodiment 17, wherein the modified oligonucleotide has a 5'-region consisting of 5 linked 5'-region nucleosides;
a central region consisting of 8 linked central region nucleosides; and
a 3'-region consisting of 5 linked 3'-region nucleosides;
wherein each of the 5'-region nucleosides and each of the 3'-region nucleosides a 2'-MOE modified sugar moiety, and each of the central region nucleosides comprises a 2'-β-D-deoxyribosyl sugar moiety.

Embodiment 22. The oligomeric compound of embodiment 17, wherein the modified oligonucleotide has a 5'-region consisting of 4 linked 5'-region nucleosides;
a central region consisting of 8 linked central region nucleosides; and
a 3'-region consisting of 6 linked 3'-region nucleosides;
wherein each of the 5'-region nucleosides and each of the 3'-region nucleosides a 2'-MOE modified sugar moiety, and each of the central region nucleosides comprises a 2'-β-D-deoxyribosyl sugar moiety.

Embodiment 23. The oligomeric compound of embodiment 17, wherein the modified oligonucleotide has
a 5'-region consisting of 4 linked 5'-region nucleosides;
a central region consisting of 8 linked central region nucleosides; and
a 3'-region consisting of 6 linked 3'-region nucleosides; wherein each of the 5'-region nucleosides and each of the 3'-region nucleosides a 2'-MOE modified sugar moiety, and each of the central region nucleosides comprises a 2'-β-D-deoxyribosyl sugar moiety.

Embodiment 24. The oligomeric compound of any of embodiments 1-23, wherein the modified oligonucleotide comprises at least one modified internucleoside linkage.

Embodiment 25. The oligomeric compound of embodiment 24, wherein each internucleoside linkage of the modified oligonucleotide is a modified internucleoside linkage.

Embodiment 26. The oligomeric compound of embodiment 24 or 25 wherein the modified internucleoside linkage is a phosphorothioate internucleoside linkage.

Embodiment 27. The oligomeric compound of embodiment 24 or 26 wherein the modified oligonucleotide comprises at least one phosphodiester internucleoside linkage.

Embodiment 28. The oligomeric compound of any of embodiments 24, 26, or 27, wherein each internucleoside linkage is independently selected from a phosphodiester internucleoside linkage or a phosphorothioate internucleoside linkage.

Embodiment 29. The oligomeric compound of embodiments 1-24 or 27-28, wherein the modified oligonucleotide has an internucleoside linkage motif selected from among: sooooossssssssssooss, sooooossssssssssoss, sooooossssssss-soss, sooossssssssssooss, sooossssssssssoooss, or soosssssssssoooss; wherein,
s=a phosphorothioate internucleoside linkage and o=a phosphodiester internucleoside linkage.

Embodiment 30. The oligomeric compound of any of embodiments 1-29, wherein the modified oligonucleotide comprises a modified nucleobase.

Embodiment 31. The oligomeric compound of embodiment 30, wherein the modified nucleobase is a 5-methyl cytosine.

Embodiment 32. The oligomeric compound of any of embodiments 1-31, wherein the modified oligonucleotide consists of 12-30, 12-22, 12-20,14-18, 14-20, 15-17, 15-25, 16-20, 18-22 or 18-20 linked nucleosides.

Embodiment 33. The oligomeric compound of any of embodiments 1-32, wherein the modified oligonucleotide consists of 18 linked nucleosides.

Embodiment 34. The oligomeric compound of any of embodiments 1-2, 4, or 6-32, wherein the modified oligonucleotide consists of 20 linked nucleosides.

Embodiment 35. The oligomeric compound of any of embodiments 1-34, consisting of the modified oligonucleotide.

Embodiment 36. The oligomeric compound of any of embodiments 1-34, comprising a conjugate group comprising a conjugate moiety and a conjugate linker.

Embodiment 37. The oligomeric compound of embodiment 36, wherein the conjugate linker consists of a single bond.

Embodiment 38. The oligomeric compound of embodiment 36, wherein the conjugate linker is cleavable.

Embodiment 39. The oligomeric compound of embodiment 36, wherein the conjugate linker comprises 1-3 linker-nucleosides.

Embodiment 40. The oligomeric compound of any of embodiments 36-39, wherein the conjugate group is attached to the modified oligonucleotide at the 5'-end of the modified oligonucleotide.

Embodiment 41. The oligomeric compound of any of embodiments 36-39, wherein the conjugate group is attached to the modified oligonucleotide at the 3'-end of the modified oligonucleotide.

Embodiment 42. The oligomeric compound of any of embodiments 1-34 or 36-41, comprising a terminal group.

Embodiment 43. The oligomeric compound of any of embodiments 1-42 wherein the oligomeric compound is a singled-stranded oligomeric compound.

Embodiment 44. The oligomeric compound of any of embodiments 1-38 or 40-43, wherein the oligomeric compound does not comprise linker-nucleosides.

Embodiment 45. An oligomeric duplex comprising an oligomeric compound of any of embodiments 1-42 or 44.

Embodiment 46. An antisense compound comprising or consisting of an oligomeric compound of any of embodiments 1-44 or an oligomeric duplex of embodiment 45.

Embodiment 47. A pharmaceutical composition comprising an oligomeric compound of any of embodiments 1-44 or an oligomeric duplex of embodiment 45 and a pharmaceutically acceptable carrier or diluent.

Embodiment 48. The pharmaceutical composition of embodiment 47, wherein the pharmaceutically acceptable diluent is artificial cerebral spinal fluid.

Embodiment 49. The pharmaceutical composition of embodiment 48, wherein the pharmaceutical composition consists essentially of the modified oligonucleotide and phosphate buffered saline.

Embodiment 50. A method comprising administering to a subject a pharmaceutical composition of any of embodiments 47-50.

Embodiment 51. A method of treating a disease associated with UBE3A-ATS comprising administering to an individual having or at risk for developing a disease associated with UBE3A-ATS a therapeutically effective amount of a pharmaceutical composition according to any of embodiments 47-49; and thereby treating the disease associated with UBE3A-ATS.

Embodiment 52. The method of embodiment 51, wherein the UBE3A-ATS-associated disease is Angelman Syndrome.

Embodiment 53. The method of any of embodiments 50-52, wherein at least one symptom or hallmark of the UBE3A-ATS-associated disease is ameliorated.

Embodiment 54. The method of embodiment 53, wherein the symptom or hallmark is developmental delays, ataxia, speech impairment, sleep problems, seizures, or EEG abnormalities.

Embodiment 55. A modified oligonucleotide according to the following chemical structure:
(SEQ ID NO: 1949)
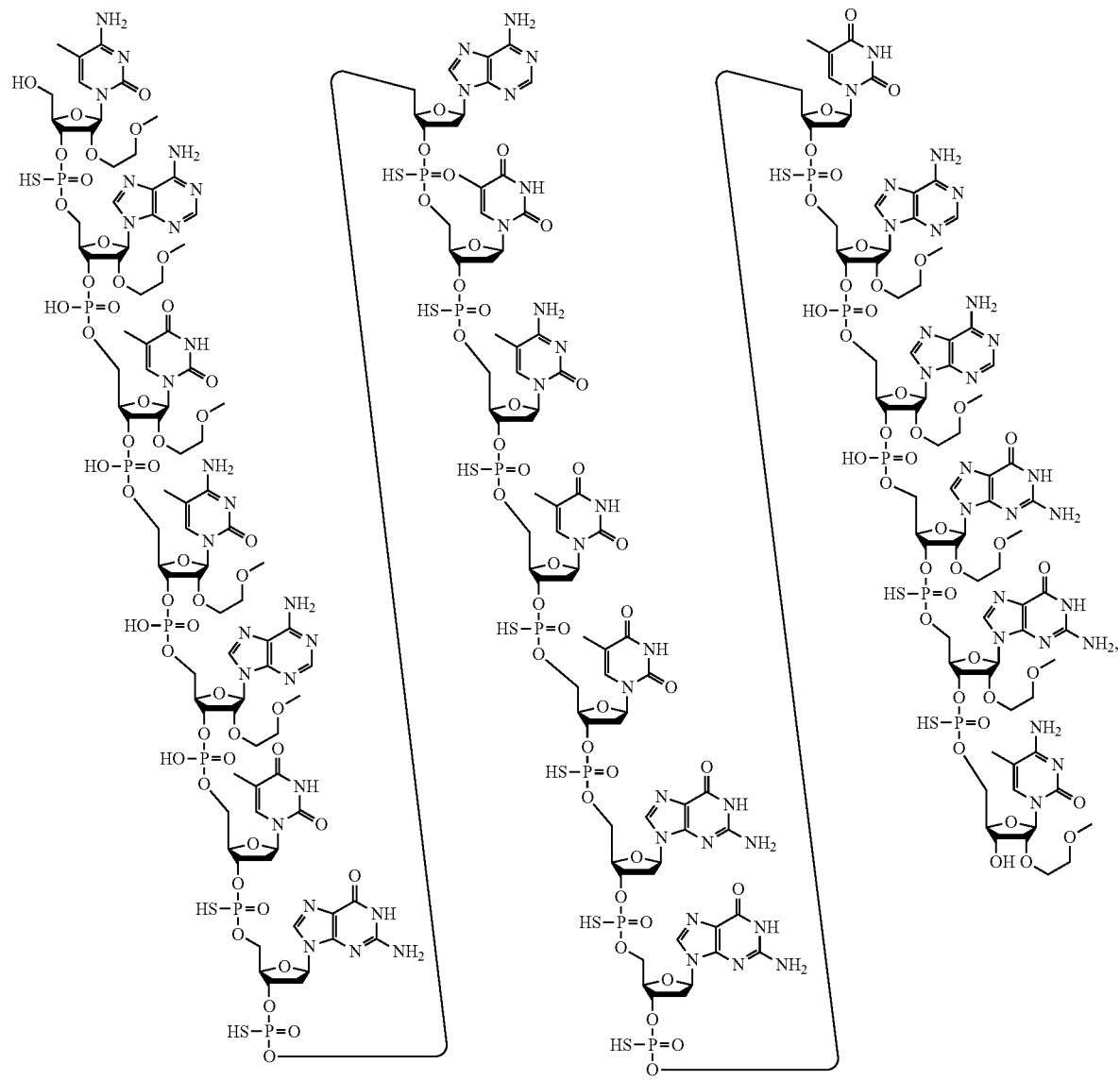
or a salt thereof.

Embodiment 56. A modified oligonucleotide according to the following chemical structure:
(SEQ ID NO: 1949)
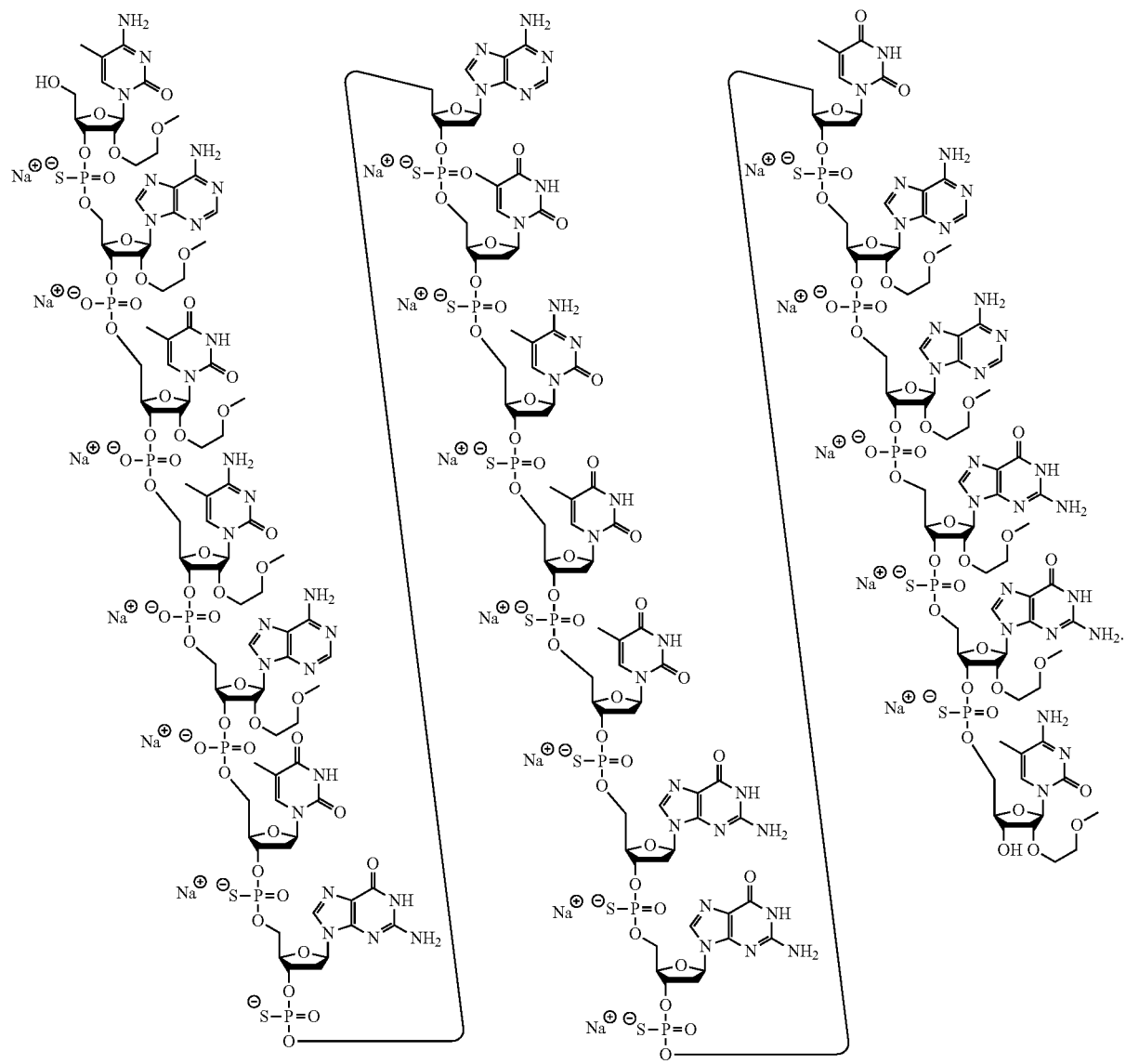

Embodiment 57. A modified oligonucleotide according to the following chemical structure:
(SEQ ID NO: 2751)
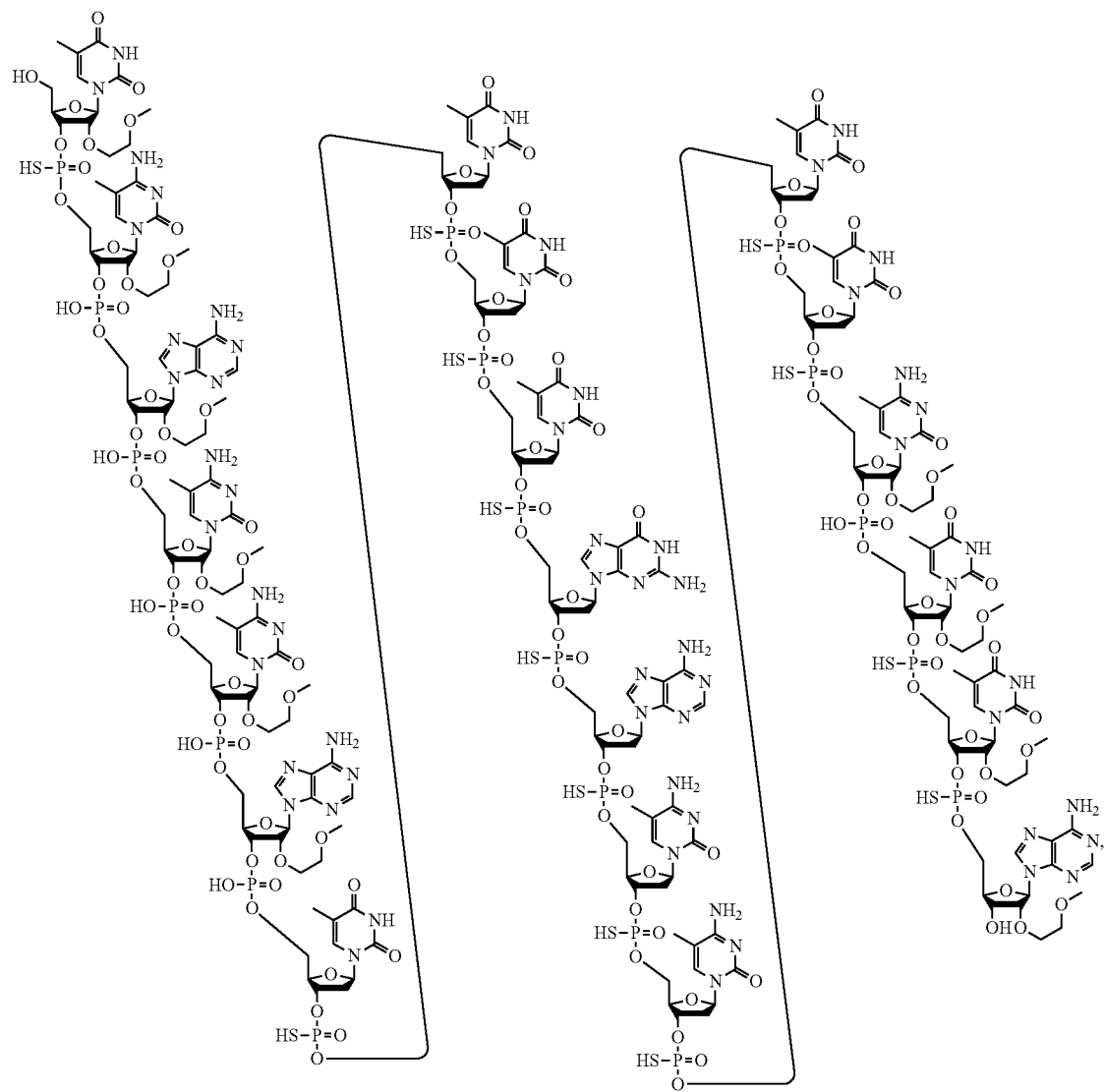
or a salt thereof.

Embodiment 58. A modified oligonucleotide according to the following chemical structure:
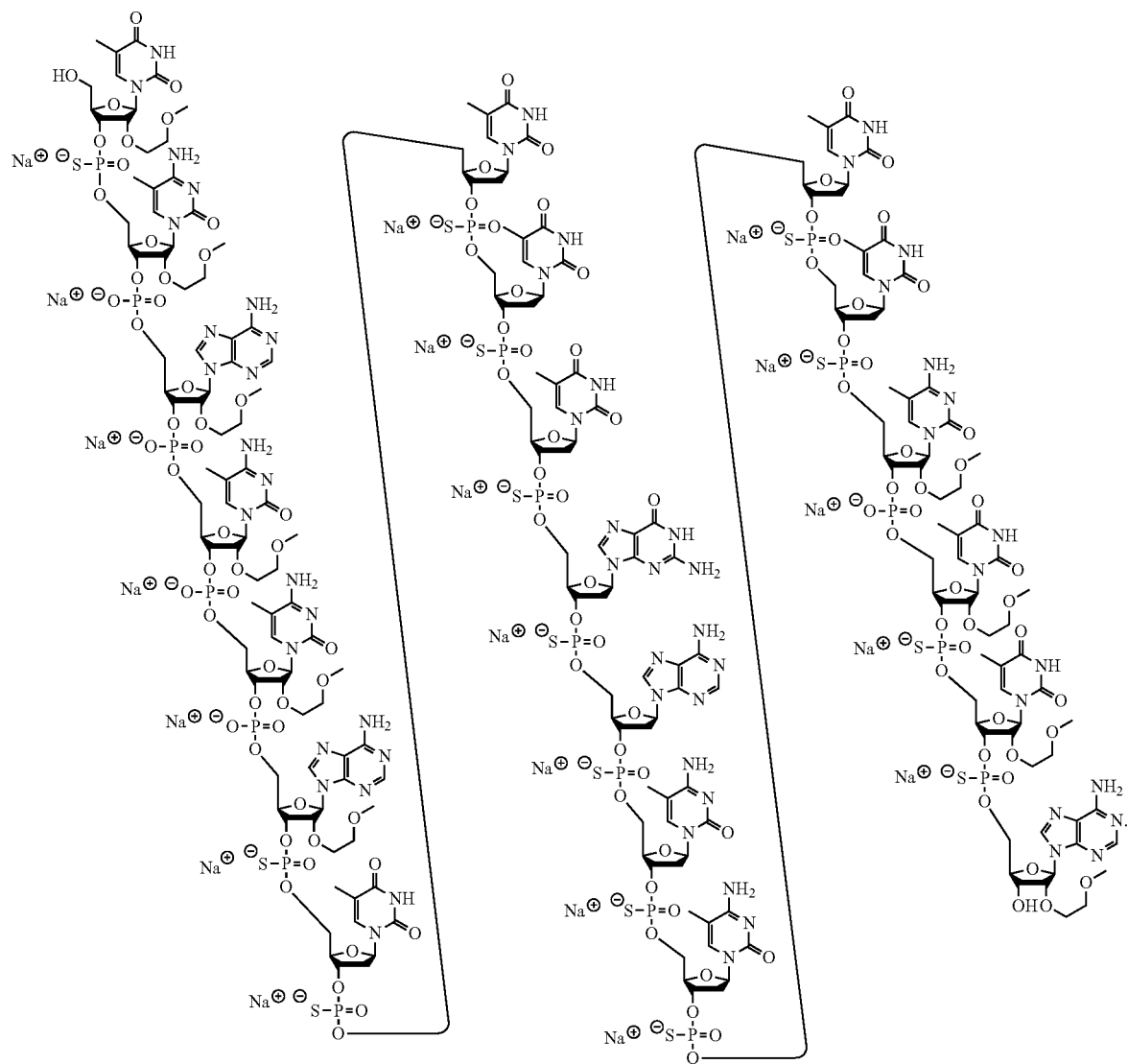
(SEQ ID NO: 2751)

Embodiment 59. A modified oligonucleotide according to the following chemical structure:
(SEQ ID NO: 2752)
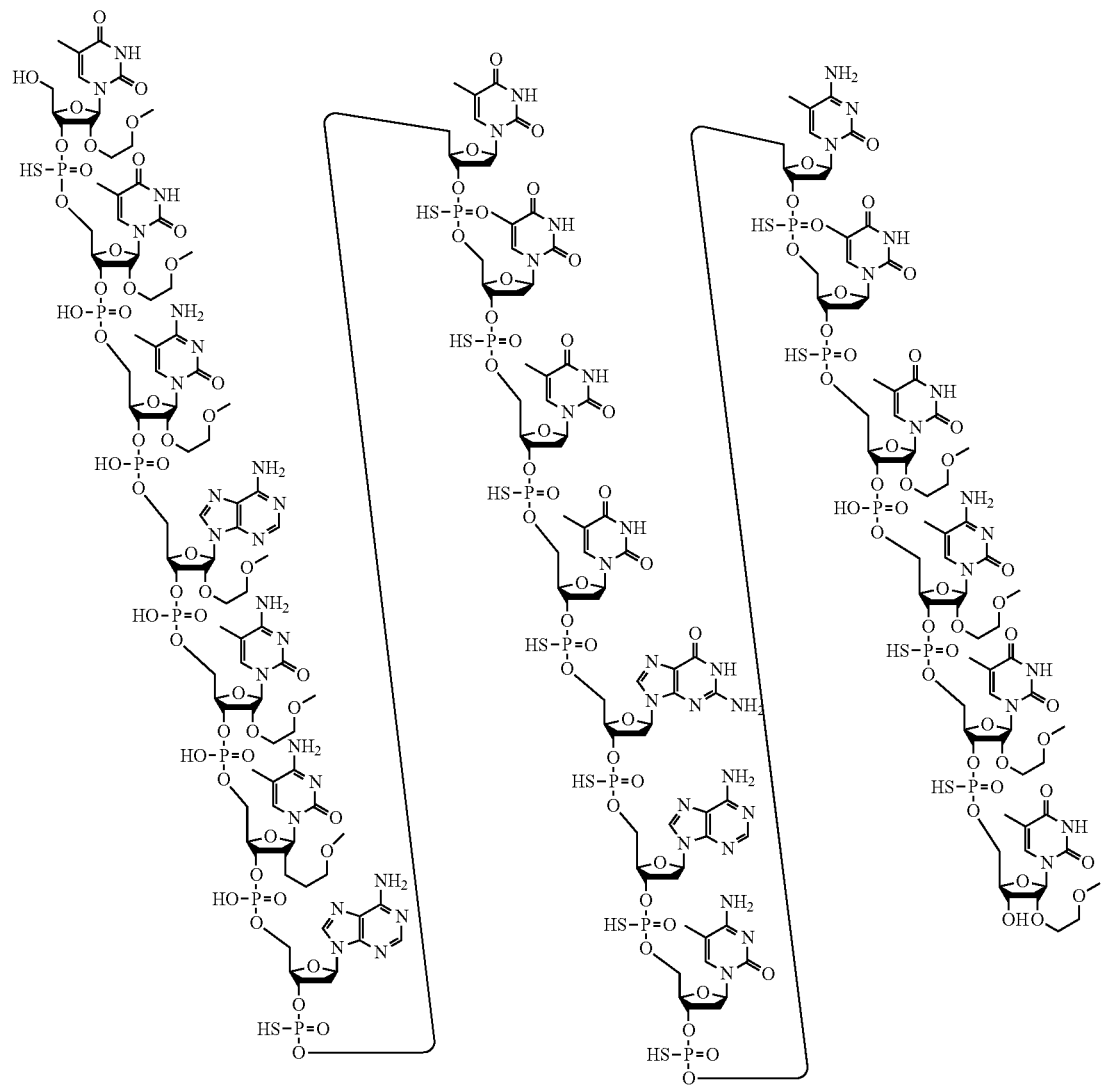
or a salt thereof.

Embodiment 60. A modified oligonucleotide corresponding to the following chemical structure:
(SEQ ID NO: 2752)
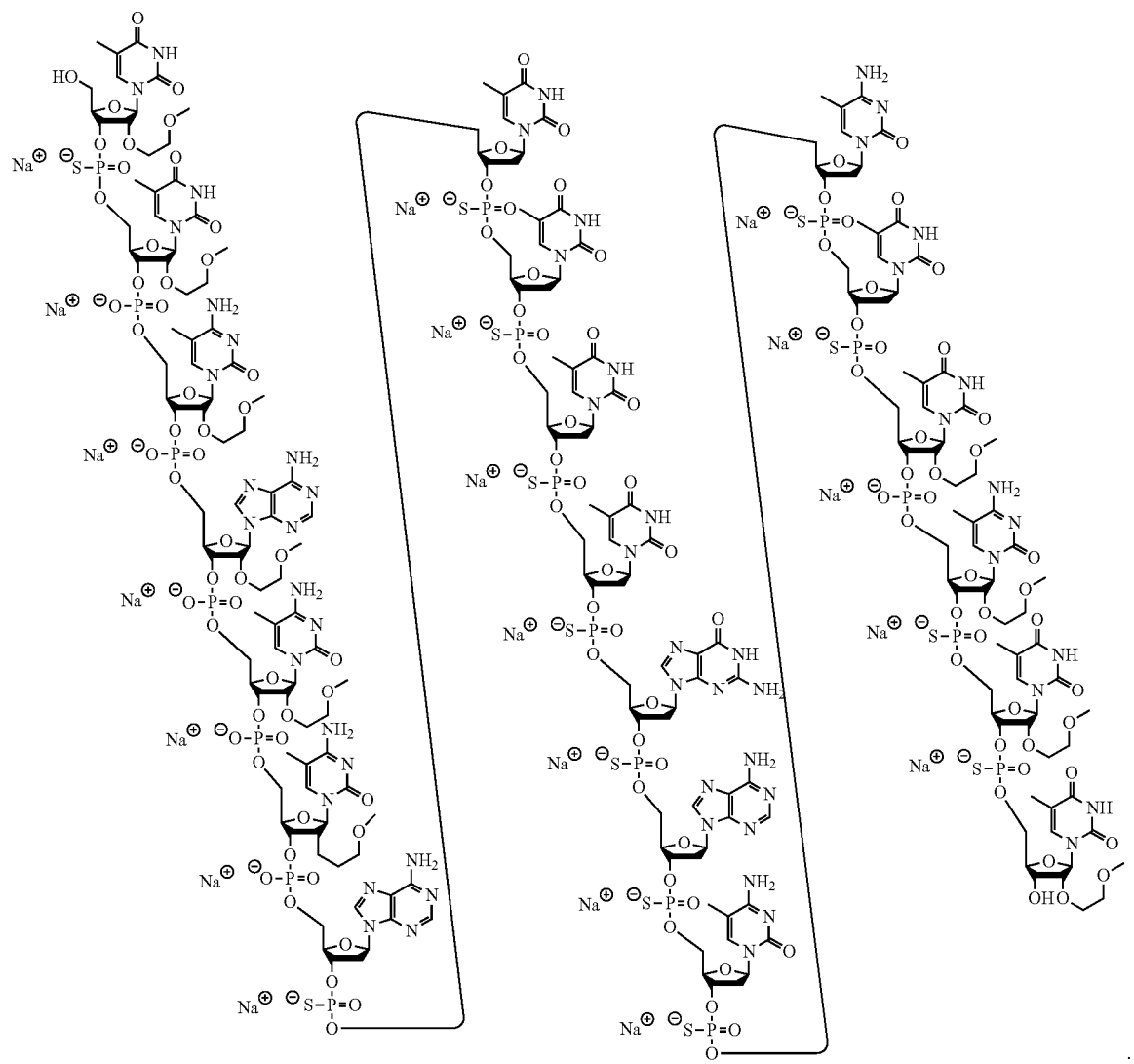

Embodiment 61. A modified oligonucleotide according to the following chemical structure:
(SEQ ID NO: 765)
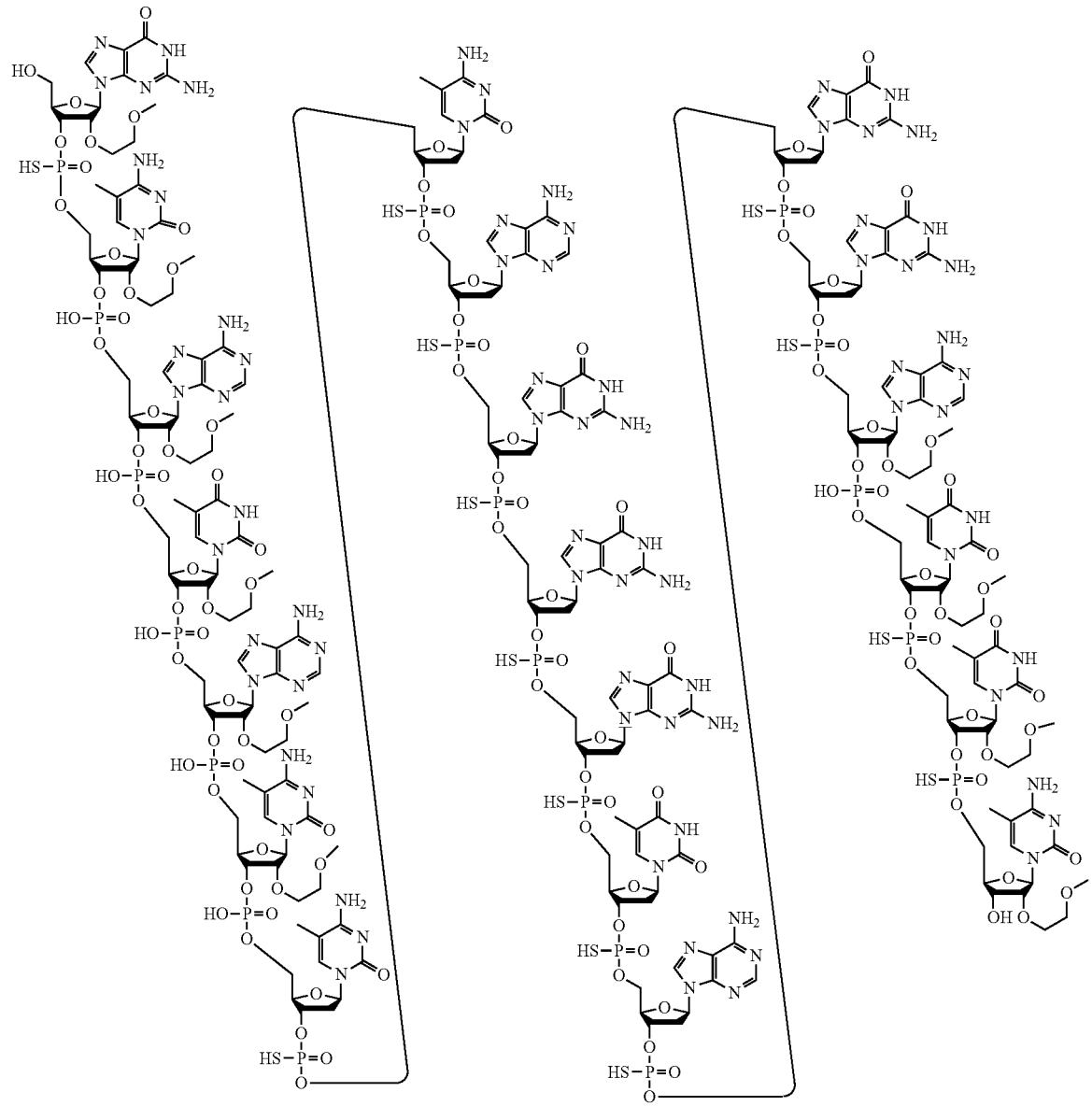
or a salt thereof.

Embodiment 62. A modified oligonucleotide according to the following chemical structure:
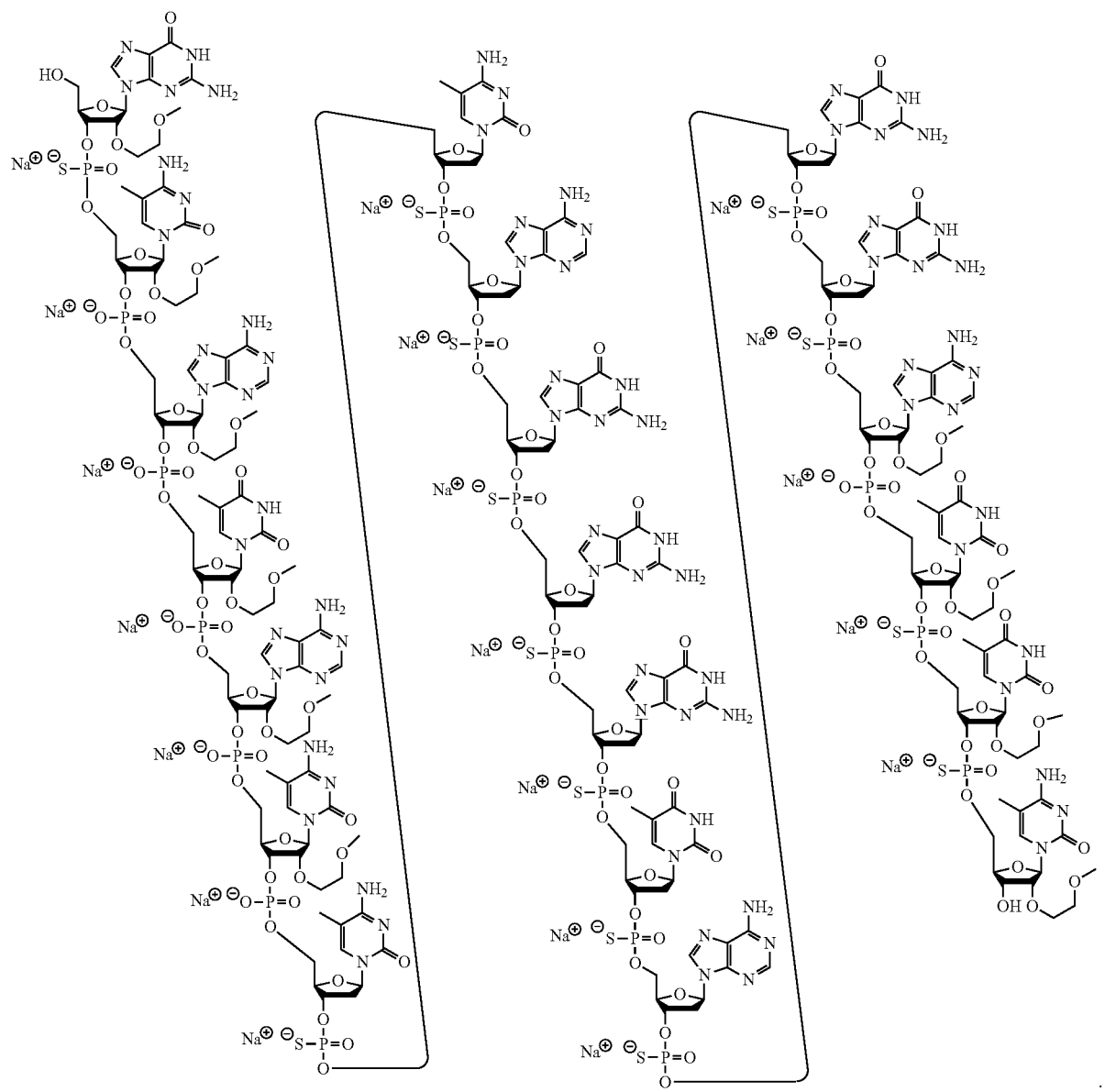
(SEQ ID NO: 765)

Embodiment 63. A modified oligonucleotide according to the following chemical structure:
(SEQ ID NO: 2866)
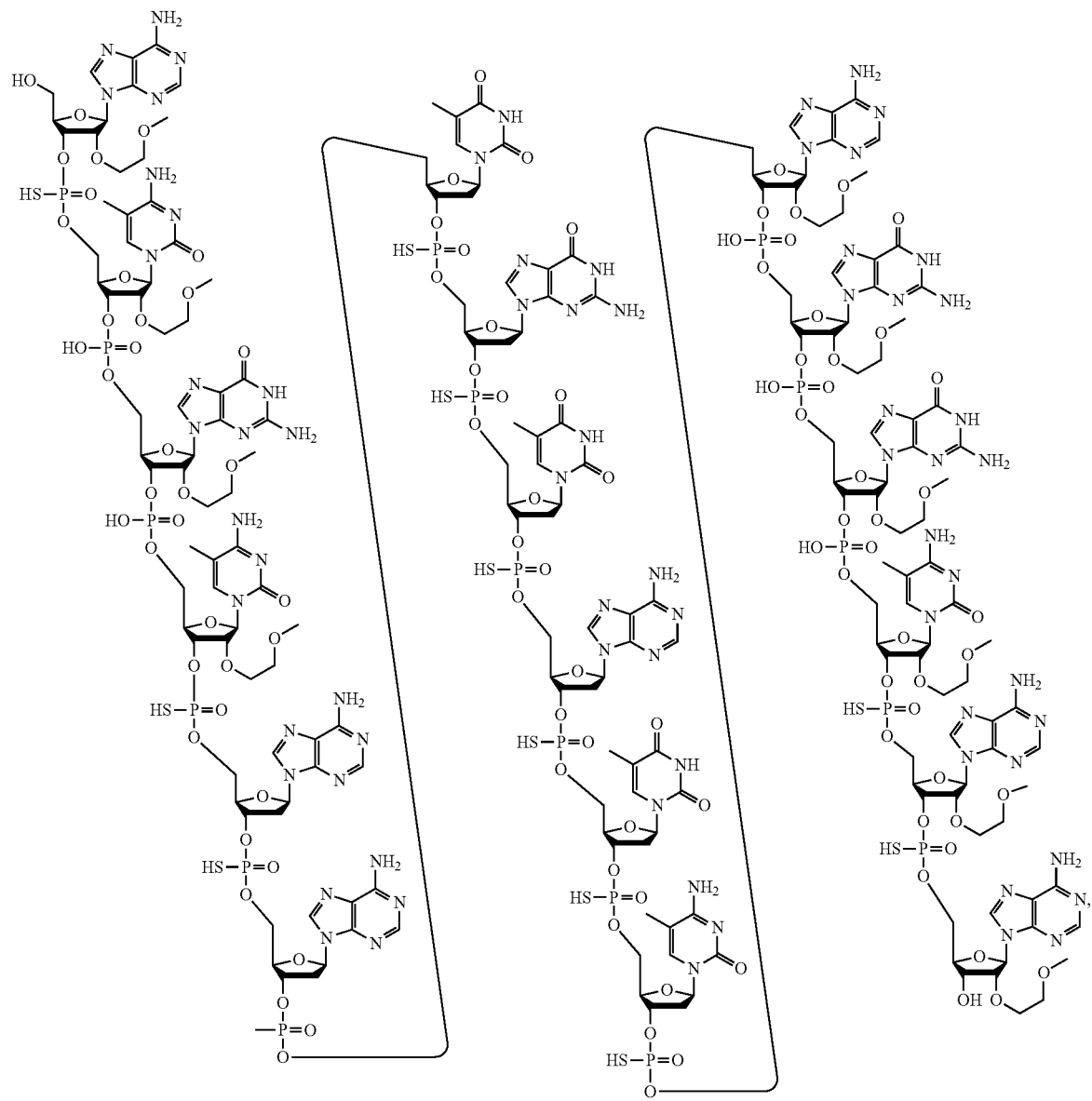
or a salt thereof.

Embodiment 64. A modified oligonucleotide according to the following chemical structure:
(SEQ ID NO: 2866)
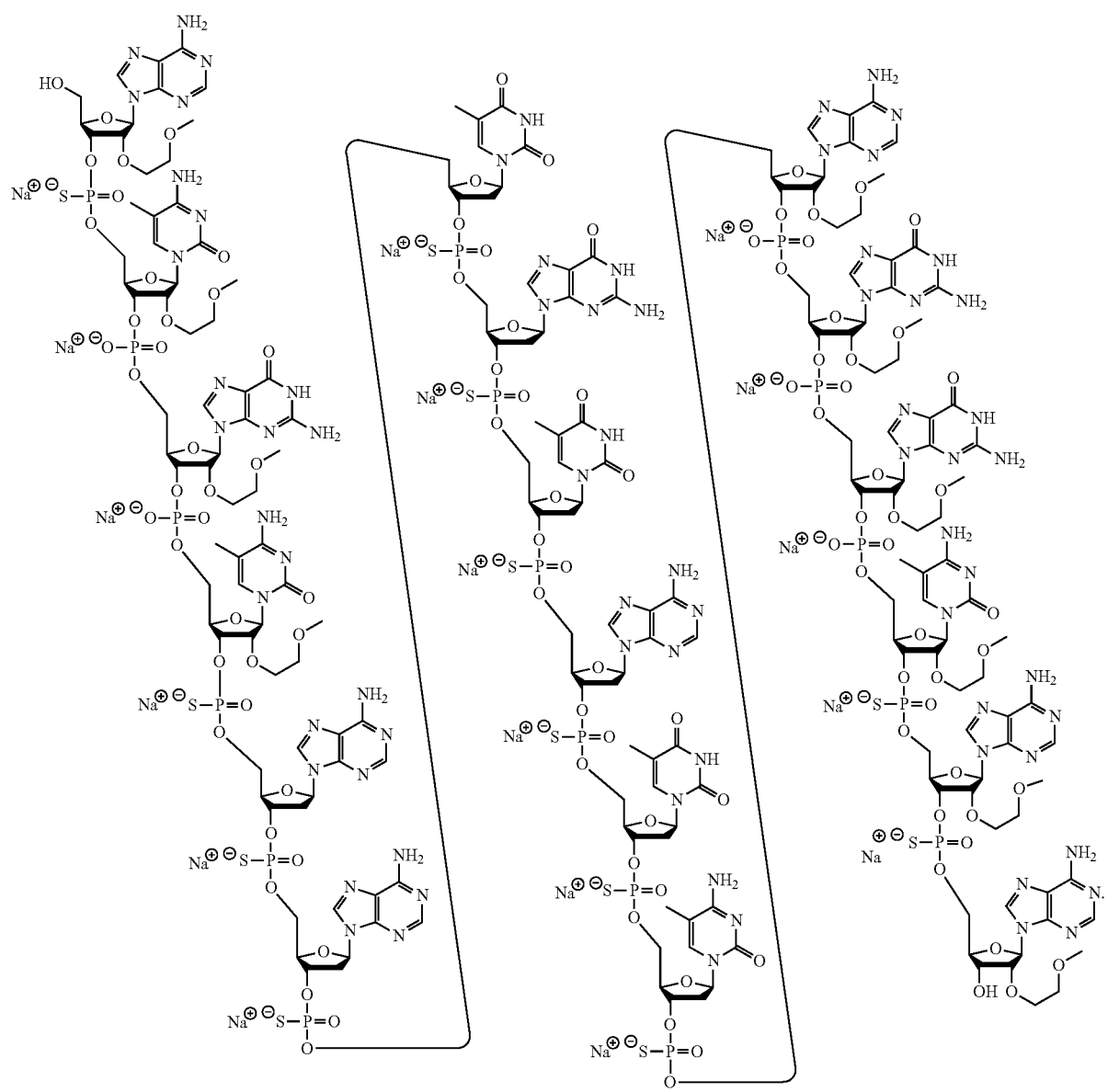

Embodiment 65. A modified oligonucleotide according to the following chemical structure:
(SEQ ID NO: 2873)
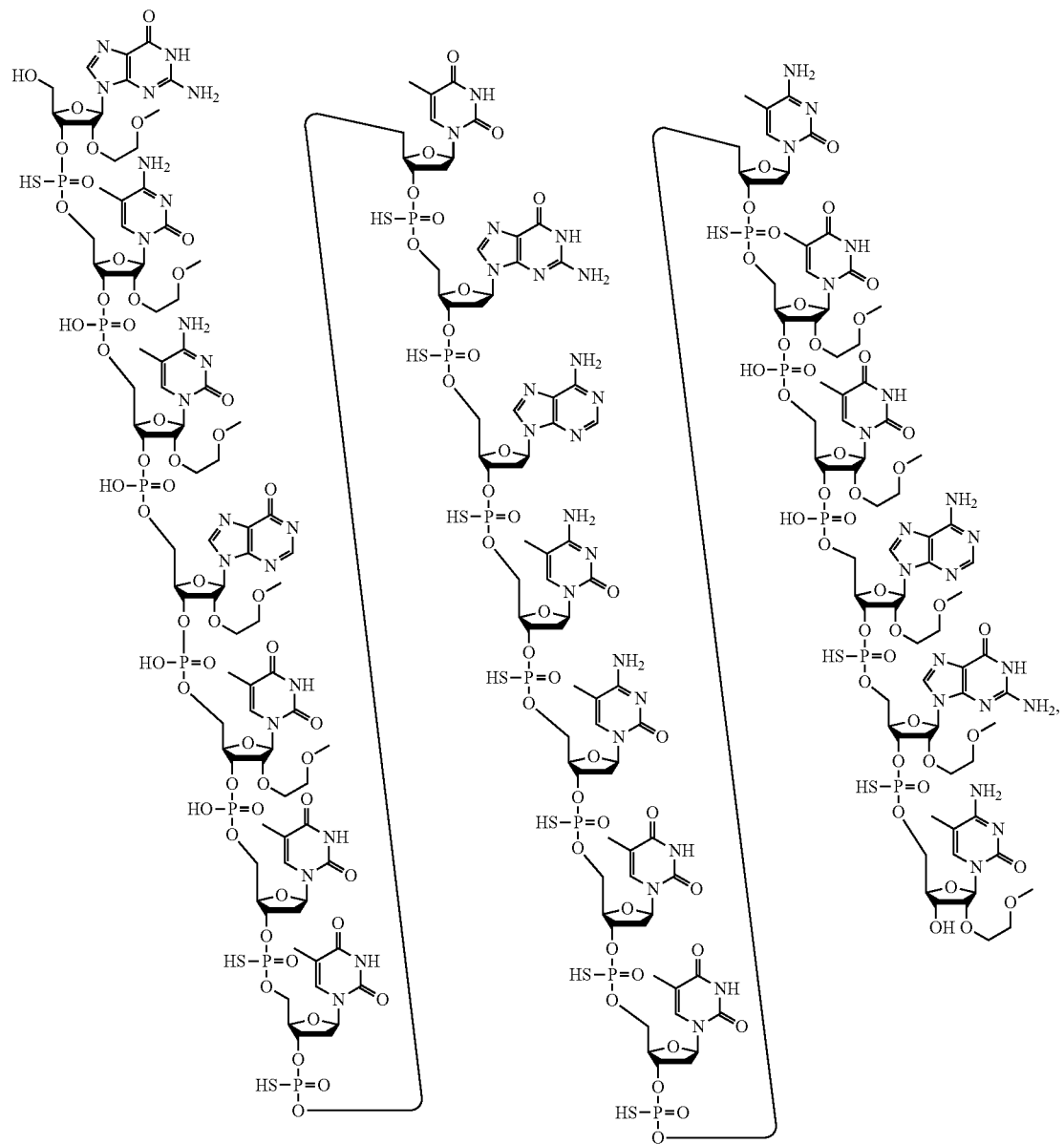
or a salt thereof.

Embodiment 66. A modified oligonucleotide according to the following chemical structure:

(SEQ ID NO: 2873)

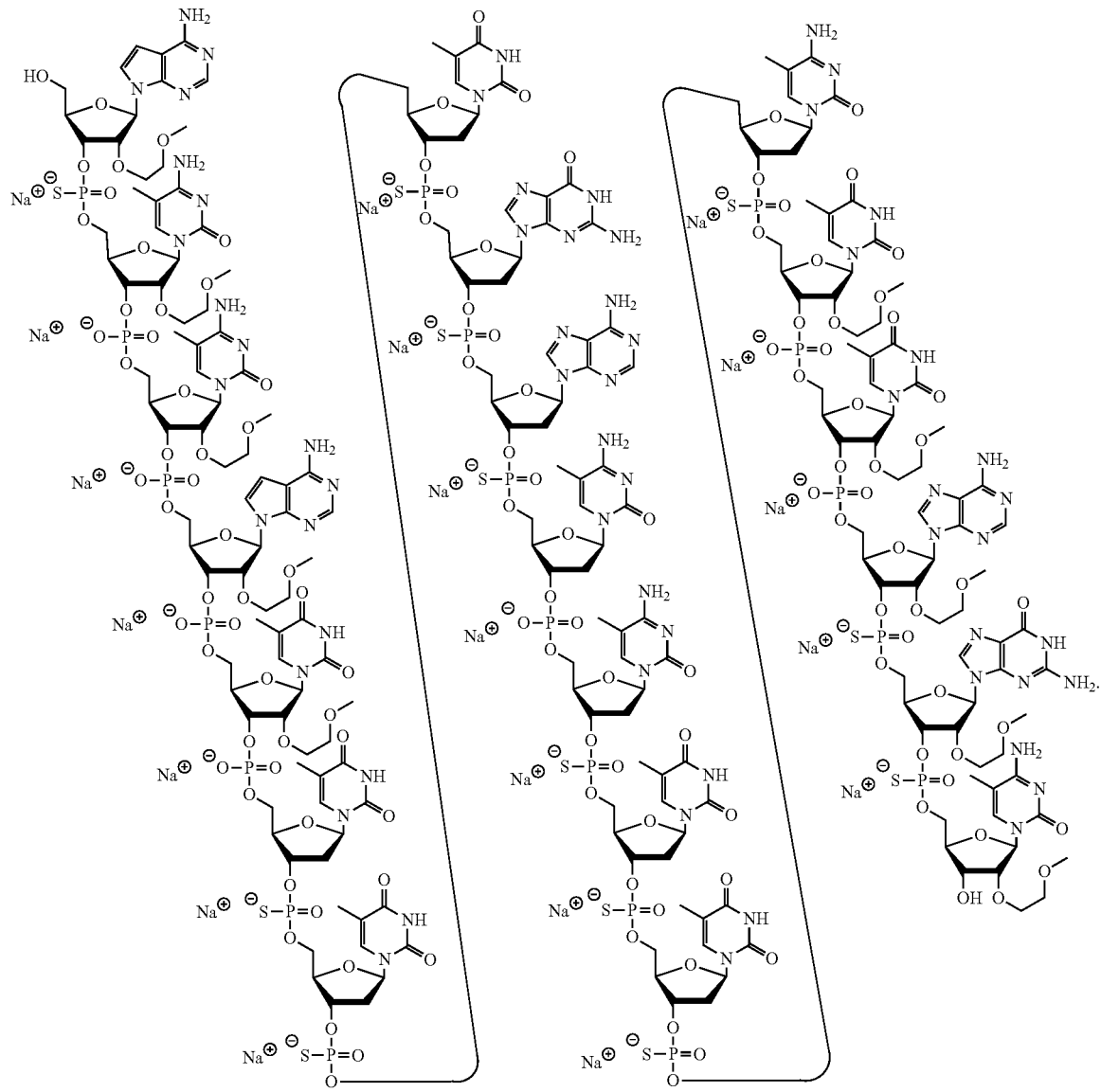

Embodiment 67. The modified oligonucleotide of any of embodiments 55, 57, 59, 61, 63, or 65, which is a sodium salt of the chemical structure.

Embodiment 68. A pharmaceutical composition comprising the modified oligonucleotide of any of embodiments 55-67 and a pharmaceutically acceptable carrier or diluent.

Embodiment 69. The pharmaceutical composition of embodiment 68, wherein the pharmaceutically acceptable diluent is artificial cerebrospinal fluid.

Embodiment 70. The pharmaceutical composition of embodiment 69, wherein the pharmaceutical composition consists essentially of the modified oligonucleotide and artificial cerebrospinal fluid.

Embodiment 71. A compound comprising a modified oligonucleotide according to the following chemical notation: $^{m}C_{es}A_{eo}T_{eo}{}^{m}C_{eo}A_{eo}T_{ds}G_{ds}A_{ds}T_{ds}{}^{m}C_{ds}T_{ds}T_{ds}G_{ds}G_{d\text{-}s}T_{ds}A_{eo}A_{eo}G_{es}G_{es}{}^{m}C_{e}$ (SEQ ID NO: 1949), wherein:

A=an adenine nucleobase,
mC=a 5-methyl cytosine nucleobase,
G=a guanine nucleobase,
T=a thymine nucleobase,
e=a 2'-MOE sugar moiety,
d=a 2'-β-D-deoxyribosyl sugar moiety,
s=a phosphorothioate internucleoside linkage, and
o=a phosphodiester internucleoside linkage.

Embodiment 72. A compound comprising a modified oligonucleotide according to the following chemical notation: $T_{es}{}^{m}C_{eo}A_{eo}{}^{m}C_{eo}{}^{m}C_{eo}A_{eo}T_{ds}T_{ds}T_{ds}G_{ds}A_{ds}{}^{m}C_{ds}{}^{m}C_{d\text{-}s}T_{ds}T_{ds}{}^{m}C_{eo}T_{es}T_{es}A_{e}$ (SEQ ID NO: 2751), wherein:

A=an adenine nucleobase,
mC=a 5-methyl cytosine nucleobase,
G=a guanine nucleobase,
T=a thymine nucleobase, e=a 2'-MOE sugar moiety,
d=a 2'-β-D-deoxyribosyl sugar moiety,
s=a phosphorothioate internucleoside linkage, and
o=a phosphodiester internucleoside linkage.

Embodiment 73. A compound comprising a modified oligonucleotide according to the following chemical notation: $T_{es}T_{eo}{}^mC_{eo}A_{eo}{}^mC_{eo}{}^mC_{eo}A_{ds}T_{ds}T_{ds}T_{ds}T_{ds}G_{ds}A_{ds}{}^mC_{ds}{}^mC_{ds}T_{ds}T_{eo}{}^mC_{es}T_{es}T_e$ (SEQ ID NO: 2752), wherein:
A=an adenine nucleobase,
mC=a 5-methyl cytosine nucleobase,
G=a guanine nucleobase,
T=a thymine nucleobase,
e=a 2'-MOE sugar moiety,
d=a 2'-β-D-deoxyribosyl sugar moiety,
s=a phosphorothioate internucleoside linkage, and
o=a phosphodiester internucleoside linkage.

Embodiment 74. A compound comprising a modified oligonucleotide according to the following chemical notation: $G_{es}{}^mC_{eo}A_{eo}T_{eo}A_{eo}{}^mC_{eo}{}^mC_{ds}{}^mC_{ds}A_{ds}G_{ds}G_{ds}G_{ds}T_{d\text{-}s}A_{ds}G_{ds}G_{ds}A_{eo}T_{es}T_{es}{}^mC_e$ (SEQ ID NO: 765), wherein:
A=an adenine nucleobase,
mC=a 5-methyl cytosine nucleobase,
G=a guanine nucleobase,
T=a thymine nucleobase,
e=a 2'-MOE sugar moiety,
d=a 2'-β-D-deoxyribosyl sugar moiety,
s=a phosphorothioate internucleoside linkage, and
o=a phosphodiester internucleoside linkage.

Embodiment 75. A compound comprising a modified oligonucleotide according to the following chemical notation: $A_{es}{}^mC_{eo}G_{eo}{}^mC_{es}A_{ds}A_{ds}T_{ds}G_{ds}T_{ds}A_{ds}T_{ds}{}^mC_{ds}A_{eo\text{-}}G_{eo}G_{eo}{}^mC_{es}A_{es}A_e$ (SEQ ID NO: 2866), wherein:
A=an adenine nucleobase,
mC=a 5-methyl cytosine nucleobase,
G=a guanine nucleobase,
T=a thymine nucleobase,
e=a 2'-MOE sugar moiety,
d=a 2'-β-D-deoxyribosyl sugar moiety,
s=a phosphorothioate internucleoside linkage, and
o=a phosphodiester internucleoside linkage.

Embodiment 76. A compound comprising a modified oligonucleotide according to the following chemical notation: $A_{es}{}^mC_{eo}{}^mC_{eo}A_{eo}T_{eo}T_{ds}T_{ds}T_{ds}G_{ds}A_{ds}{}^mC_{ds}{}^mC_{ds}T_{ds}T_{ds}{}^mC_{ds}T_{eo}T_{eo}A_{es}G_{es}{}^mC_e$ (SEQ ID NO: 2873), wherein:
A=an adenine nucleobase,
mC=a 5-methyl cytosine nucleobase,
G=a guanine nucleobase,
T=a thymine nucleobase,
e=a 2'-MOE sugar moiety,
d=a 2'-β-D-deoxyribosyl sugar moiety,
s=a phosphorothioate internucleoside linkage, and
o=a phosphodiester internucleoside linkage.

Embodiment 77. The compound of any of embodiments 71-76, comprising the modified oligonucleotide covalently linked to a conjugate group.

Embodiment 78. A pharmaceutical composition of any of embodiments 71-77, and a pharmaceutically acceptable diluent or carrier.

Embodiment 79. The pharmaceutical composition of embodiment 78, wherein the pharmaceutically acceptable diluent is artificial cerebrospinal fluid.

Embodiment 80. The pharmaceutical composition of embodiment 79, wherein the pharmaceutical composition consists essentially of the modified oligonucleotide and artificial cerebrospinal fluid.

Embodiment 81. A chirally enriched population of modified oligonucleotides of any of embodiments 55-67, wherein the population is enriched for modified oligonucleotides comprising at least one particular phosphorothioate internucleoside linkage having a particular setereochemical configuration.

Embodiment 82. The chirally enriched population of embodiment 81, wherein the population is enriched for modified oligonucleotides comprising at least one particular phorphorothioate internucleoside linkage having the (Sp) configuration.

Embodiment 83. The chirally enriched population of embodiment 81, wherein the population is enriched for modified oligonucleotides comprising at least one particular phorphorothioate internucleoside linkage having the (Rp) configuration.

Embodiment 84. The chirally enriched population of embodiment 81, wherein the population is enriched for modified oligonucleotides having a particular, independently selected stereochemical configuration at each phosphorothioate internucleoside linkage Embodiment 85. The chirally enriched population of embodiment 84, wherein the population is enriched for modified oligonucleotides having the (Sp) configuration at each phosphorothioate internucleoside linkage.

Embodiment 86. The chirally enriched population of embodiment 84, wherein the population is enriched for modified oligonucleotides having the (Rp) configuration at each phosphorothioate internucleoside linkage.

Embodiment 87. The chirally enriched population of embodiment 84, wherein the population is enriched for modified oligonucleotides having the (Rp) configuration at one particular phosphorothioate internucleoside linkage and the (Sp) configuration at each of the remaining phosphorothioate internucleoside linkages.

Embodiment 88. The chirally enriched population of embodiment 81 or embodiment 84 wherein the population is enriched for modified oligonucleotides having at least 3 contiguous phosphorothioate internucleoside linkages in the Sp, Sp, and Rp configurations, in the 5' to 3' direction.

Embodiment 89. A chirally enriched population of modified oligonucleotides of any of embodiments 55-67, wherein all of the phosphorothioate internucleoside linkages of the modified oligonucleotide are stereorandom.

I. Certain Oligonucleotides

In certain embodiments, provided herein are oligomeric compounds comprising oligonucleotides, which consist of linked nucleosides. Oligonucleotides may be unmodified oligonucleotides (RNA or DNA) or may be modified oligonucleotides. Modified oligonucleotides comprise at least one modification relative to unmodified RNA or DNA. That is, modified oligonucleotides comprise at least one modified nucleoside (comprising a modified sugar moiety and/or a modified nucleobase) and/or at least one modified internucleoside linkage.

A. Certain Modified Nucleosides

Modified nucleosides comprise a modified sugar moiety or a modified nucleobase or both a modifed sugar moiety and a modified nucleobase.

1. Certain Sugar Moieties

In certain embodiments, modified sugar moieties are non-bicyclic modified sugar moieties. In certain embodiments, modified sugar moieties are bicyclic or tricyclic sugar moieties. In certain embodiments, modified sugar moieties are sugar surrogates. Such sugar surrogates may comprise one or more substitutions corresponding to those of other types of modified sugar moieties.

In certain embodiments, modified sugar moieties are non-bicyclic modified sugar moieties comprising a furanosyl ring with one or more substituent groups none of which bridges two atoms of the fumnosyl ring to form a bicyclic structure. Such non bridging substituents may be at any position of the furanosyl, including but not limited to substituents at the 2', 4', and/or 5' positions. In certain embodiments one or more non-bridging substituent of non-bicyclic modified sugar moieties is branched. Examples of 2'-substituent groups suitable for non-bicyclic modified sugar moieties include but are not limited to: 2'-F, 2'-OCH$_3$ ("OMe" or "O-methyl"), and 2'-O(CH$_2$)$_2$OCH$_3$ ("MOE"). In certain embodiments, 2'-substituent groups are selected from among: halo, allyl, amino, azido, SH, CN, OCN, CF$_3$, OCF$_3$, O—C$_1$-C$_{10}$ alkoxy, O—C$_1$-C$_{10}$ substituted alkoxy, O—C$_1$-C$_{10}$ alkyl, O—C$_1$-C$_{10}$ substituted alkyl, S-alkyl, N(R$_m$)- alkyl, O-alkenyl, S-alkenyl, N(R$_m$)-alkenyl, O-alkynyl, S-alkynyl, N(R$_m$)-alkynyl, O-alkylenyl-O-alkyl, alkynyl, alkaryl, aralkyl, O-alkaryl, O-aralkyl, O(CH$_2$)$_2$SCH$_3$, O(CH$_2$)$_2$ON(R$_m$)(R$_n$) or OCH$_2$C(=O)—N(R$_m$)(R$_n$), where each R$_m$ and R$_n$ is, independently, H, an amino protecting group, or substituted or unsubstituted C$_1$-C$_{10}$ alkyl, and the 2'-substituent groups described in Cook et al., U.S. Pat. No. 6,531,584; Cook et al., U.S. Pat. No. 5,859,221; and Cook et al., U.S. Pat. No. 6,005,087. Certain embodiments of these 2'-substituent groups can be further substituted with one or more substituent groups independently selected from among: hydroxyl, amino, alkoxy, carboxy, benzyl, phenyl, nitro (NO$_2$), thiol, thioalkoxy, thioalkyl, halogen, alkyl, aryl, alkenyl and alkynyl. Examples of 4'-substituent groups suitable for non-bicyclic modified sugar moieties include but are not limited to alkoxy (e.g., methoxy), alkyl, and those described in Manoharan et al., WO 2015/106128. Examples of 5'-substituent groups suitable for non-bicyclic modified sugar moieties include but are not limited to: 5-methyl (R or S), 5'-vinyl, and 5'-methoxy. In certain embodiments, non-bicyclic modified sugar moieties comprise more than one non-bridging sugar substituent, for example, 2'-F-5'-methyl sugar moieties and the modified sugar moieties and modified nucleosides described in Migawa et al., WO 2008/101157 and Rajeev et al., US2013/0203836.

In certain embodiments, a 2'-substituted non-bicyclic modified nucleoside comprises a sugar moiety comprising a non-bridging 2'-substituent group selected from: F, NH$_2$, N$_3$, OCF$_3$, OCH$_3$, O(CH$_2$)$_3$NH$_2$, CH$_2$CH=CH$_2$, OCH$_2$CH=CH$_2$, OCH$_2$CH$_2$OCH$_3$, O(CH$_2$)$_2$SCH$_3$, O(CH$_2$)$_2$ ON(R$_m$)(R$_n$), O(CH$_2$)$_2$O(CH$_2$)$_2$N(CH$_3$)$_2$, and N-substituted acetamide (OCH$_2$C(=O)—N(R$_m$)(R$_n$)), where each R$_m$ and R$_n$ is, independently, H, an amino protecting group, or substituted or unsubstituted C$_1$-C$_{10}$ alkyl.

In certain embodiments, a 2'-substituted nucleoside non-bicyclic modified nucleoside comprises a sugar moiety comprising a non-bridging 2'-substituent group selected from: F, OCF$_3$, OCH$_3$, OCH$_2$CH$_2$OCH$_3$, O(CH$_2$)$_2$SCH$_3$, O(CH$_2$)$_2$ON(CH$_3$)$_2$, O(CH$_2$)$_2$O(CH$_2$)$_2$N(CH$_3$)$_2$, and OCH$_2$C(=O)—N(H)CH$_3$ ("NMA").

In certain embodiments, a 2'-substituted non-bicyclic modified nucleoside comprises a sugar moiety comprising a non-bridging 2'-substituent group selected from: F, OCH$_3$, and OCH$_2$CH$_2$OCH$_3$.

Certain modifed sugar moieties comprise a substituent that bridges two atoms of the furanosyl ring to form a second ring, resulting in a bicyclic sugar moiety. In certain such embodiments, the bicyclic sugar moiety comprises a bridge between the 4' and the 2' furanose ring atoms. Examples of such 4' to 2' bridging sugar substituents include but are not limited to: 4'-CH$_2$-2', 4'-(CH$_2$)$_2$-2', 4'-(CH$_2$)$_3$-2', 4'-CH$_2$—O-2' ("LNA"), 4'-(CH$_2$)$_2$-O-2' ("ENA"), 4'-CH(CH$_3$)—O-2' (referred to as "constrained ethyl" or "cEt"), 4'-CH$_2$—O—CH$_2$-2', 4'-CH$_2$—N(R)-2', 4'-CH(CH$_2$OCH$_3$)—O-2' ("constrained MOE" or "cMOE") and analogs thereof (see, e.g., Seth et al., U.S. Pat. No. 7,399,845, Bhat et al., U.S. Pat. No. 7,569,686, Swayze et al., U.S. Pat. No. 7,741,457, and Swayze et al., U.S. Pat. No. 8,022,193), 4'-C(CH$_3$)(CH$_3$)—O-2' and analogs thereof (see, e.g., Seth et al., U.S. Pat. No. 8,278,283), 4'-CH$_2$—N(OCH$_3$)-2' and analogs thereof (see, e.g., Prakash et al., U.S. Pat. No. 8,278,425), 4'-CH$_2$—O—N(CH$_3$)-2' (see, e.g., Allerson et al., U.S. Pat. No. 7,696,345 and Allerson et al., U.S. Pat. No. 8,124,745), 4'-CH$_2$—C(H)(CH$_3$)- 2' (see, e.g., Zhou, et al., J. Org. Chem.,2009, 74, 118-134), 4'-CH$_2$—C(=CH$_2$)-2' and analogs thereof (see e.g., Seth et al., U.S. Pat. No. 8,278,426), 4'-C(R$_a$R$_b$)—N(R)—O-2', 4'-C(R$_a$R$_b$)—O—N(R)-2', 4'-CH$_2$—O—N(R)-2', and 4'-CH$_2$—N(R)—O- 2', wherein each R, R$_a$, and R$_b$ is, independently, H, a protecting group, or C$_1$-C$_{12}$ alkyl (see, e.g. Imanishi et al., U.S. Pat. No. 7,427,672).

In certain embodiments, such 4' to 2' bridges independently comprise from 1 to 4 linked groups independently selected from: —[C(R$_a$)(R$_b$)]$_n$—, —[C(R$_a$)(R$_b$)]$_n$—O—, —C(R$_a$)=C(R$_b$)—, —C(R$_a$)=N—, —C(=NR$_a$)—, —C(=O)—, —C(=S)—, —O—, —Si(R$_a$)$_2$—, —S(=O)$_x$—, and —N(R$_a$)—;

wherein:

x is 0, 1, or 2;

n is 1, 2, 3, or 4;

each R$_a$ and R$_b$ is, independently, H, a protecting group, hydroxyl, C$_1$-C$_{12}$ alkyl, substituted C$_1$-C$_{12}$ alkyl, C$_2$-C$_{12}$ alkenyl, substituted C$_2$-C$_{12}$ alkenyl, C$_2$-C$_{12}$ alkynyl, substituted C$_2$-C$_{12}$ alkynyl, C$_5$-C$_{20}$ aryl, substituted C$_5$-C$_{20}$ aryl, heterocycle radical, substituted heterocycle radical, heteroaryl, substituted heteroaryl, C$_5$-C$_7$ alicyclic radical, substituted C$_5$-C$_7$ alicyclic radical, halogen, OJ$_1$, NJ$_1$J$_2$, SJ$_1$, N$_3$, COOJ$_1$, acyl (C(=O)—H), substituted acyl, CN, sulfonyl (S(=O)$_2$-J$_1$), or sulfoxyl (S(=O)-J$_1$); and each J$_1$ and J2 is, independently, H, C$_1$-C$_{12}$ alkyl, substituted C$_1$-C$_{12}$ alkyl, C$_2$-C$_{12}$ alkenyl, substituted C$_2$-C$_{12}$ alkenyl, C$_2$-C$_{12}$ alkynyl, substituted C$_2$-C$_{12}$ alkynyl, C$_5$-C$_{20}$ aryl, substituted C$_5$-C$_{20}$ aryl, acyl (C(=O)—H), substituted acyl, a heterocycle radical, a substituted heterocycle radical, C$_1$-C$_{12}$ aminoalkyl, substituted C$_1$-C$_{12}$ aminoalkyl, or a protecting group.

Additional bicyclic sugar moieties are known in the art, see, for example: Freier et al., *Nucleic Acids Research*, 1997, 25(22), 4429-4443, Albaek et al., *J. Org. Chem.*, 2006, 71, 7731-7740, Singh et al., *Chem. Commun.*, 1998, 4, 455-456; Koshkin et al., *Tetrahedron*, 1998, 54, 3607-3630; Kumar et al., *Bioorg. Med. Chem. Lett.*, 1998, 8, 2219-2222; Singh et al., *J. Org. Chem.*, 1998, 63, 10035-10039; Srivastava et al., *J. Am. Chem. Soc.*, 2007, 129, 8362-8379; Wengel et a., U.S. Pat. No. 7,053,207; Imanishi et al., U.S. Pat. No. 6,268,490; Imanishi et al. U.S. Pat. No.6,770,748; Imanishi et al., U.S. Pat. No. RE44,779; Wengel et al., U.S. Pat. No. 6,794,499; Wengel et al., U.S. Pat. No. 6,670,461; Wengel et al., U.S. Pat. No. 7,034,133; Wengel et al., U.S. Pat. No. 8,080,644; Wengel et al., U.S. Pat. No. 8,034,909; Wengel et al., U.S. Pat. No. 8,153,365; Wengel et al., U.S. Pat. No. 7,572,582; Ramasamy et al., U.S. Pat. No. 6,525,191; Torsten et al., WO 2004/106356; Wengel et al., WO 1999/014226; Seth et al., WO 2007/134181; Seth et al., U.S. Pat. No. 7,547,684; Seth et al., U.S. Pat. No. 7,666,854; Seth et al., U.S. Pat. No. 8,088,746; Seth et al., U.S. Pat. No. 7,750,131; Seth et al., U.S. Pat. No. 8,030,467; Seth et al., U.S. Pat. No. 8,268,980; Seth et al., U.S. Pat. No. 8,546,556; Seth et al., U.S. Pat. No. 8,530,640; Migawa et al., U.S. Pat. No. 9,012,421; Seth et al., U.S. Pat. No. 8,501,805; and U.S. Patent Publication Nos. Allerson et al., US2008/0039618 and Migawa et al., US2015/0191727.

In certain embodiments, bicyclic sugar moieties and nucleosides incorporating such bicyclic sugar moieties are further defined by isomeric configuration. For example, an LNA nucleoside (described herein) may be in the α-L configuration or in the β-D configuration.

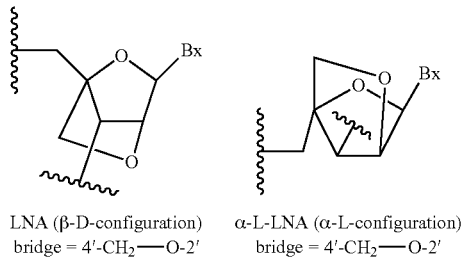

LNA (β-D-configuration)
bridge = 4'-CH$_2$—O-2'

α-L-LNA (α-L-configuration)
bridge = 4'-CH$_2$—O-2'

α-L-methyleneoxy (4'-CH$_2$—O-2') or α-L-LNA bicyclic nucleosides have been incorporated into oligonucleotides that showed antisense activity (Frieden et al., *Nucleic Acids Research*, 2003, 21, 6365-6372). Herein, general descriptions of bicyclic nucleosides include both isomeric configurations. When the positions of specific bicyclic nucleosides (e.g., LNA or cEt) are identified in exemplified embodiments herein, they are in the β-D configuration, unless otherwise specified.

In certain embodiments, modified sugar moieties comprise one or more non-bridging sugar substituent and one or more bridging sugar substituent (e.g., 5'-substituted and 4'-2' bridged sugars).

In certain embodiments, modified sugar moieties are sugar surrogates. In certain such embodiments, the oxygen atom of the sugar moiety is replaced, e.g., with a sulfur, carbon or nitrogen atom. In certain such embodiments, such modified sugar moieties also comprise bridging and/or non-bridging substituents as described herein. For example, certain sugar surrogates comprise a 4'-sulfur atom and a substitution at the 2'-position (see, e.g., Bhat et al., U.S. Pat. No. 7,875,733 and Bhat et al., U.S. 7,939,677) and/or the 5' position.

In certain embodiments, sugar surrogates comprise rings having other than 5 atoms. For example, in certain embodiments, a sugar surrogate comprises a six-membered tetrahydropyran ("THP"). Such tetrahydropyrans may be further modified or substituted. Nucleosides comprising such modified tetrahydropyrans include but are not limited to hexitol nucleic acid ("HNA"), anitol nucleic acid ("ANA"), manitol nucleic acid ("MNA") (see, e.g., Leumann, C J. *Bioorg. & Med. Chem.* 2002, 10, 841-854), fluoro HNA:

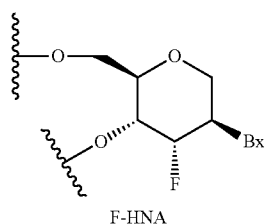

F-HNA ("F-HNA", see e.g. Swayze et al., U.S. Pat. No. 8,088,904; Swayze et al., U.S. Pat. No. 8,440,803; Swayze et al., U.S. Pat. No. 8,796,437; and Swayze et al., U.S. Pat. No. 9,005,906; F-HNA can also be referred to as a F-THP or 3$^1$-fluoro tetrahydropyran), and nucleosides comprising additional modified THP compounds having the formula:

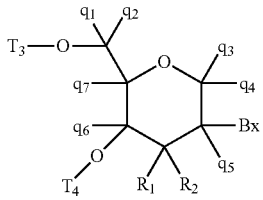

wherein, independently, for each of said modified THP nucleoside:

Bx is a nucleobase moiety;

$T_3$ and $T_4$ are each, independently, an internucleoside linking group linking the modified THP nucleoside to the remainder of an oligonucleotide or one of $T_3$ and $T_4$ is an internucleoside linking group linking the modified THP nucleoside to the remainder of an oligonucleotide and the other of $T_3$ and $T_4$ is H, a hydroxyl protecting group, a linked conjugate group, or a 5' or 3'-terminal group;

$q_1$, $q_2$, $q_3$, $q_4$, $q_5$, $q_6$ and $q_7$ are each, independently, H, $C_1$-$C_6$ alkyl, substituted $C_1$-$C_6$ alkyl, $C_2$-$C_6$ alkenyl, substituted $C_2$-$C_6$ alkenyl, $C_2$-$C_6$ alkynyl, or substituted $C_2$-$C_6$ alkynyl; and each of $R_1$ and $R_2$ is independently selected from among: hydrogen, halogen, substituted or unsubstituted alkoxy, $NJ_1J_2$, $SJ_1$, $N_3$, OC(=X)$J_1$, OC(=X)$NJ_1J_2$, $NJ_3C(=X)NJ_1J_2$, and CN, wherein X is O, S or $NJ_1$, and each $J_1$, $J_2$, and $J_3$ is, independently, H or $C_1$-$C_6$ alkyl.

In certain embodiments, modified THP nucleosides are provided wherein $q_1$, $q_2$, $q_3$, $q_4$, $q_5$, $q_6$ and $q_7$ are each H. In certain embodiments, at least one of $q_1$, $q_2$, $q_3$, $q_4$, $q_5$, $q_6$ and $q_7$ is other than H. In certain embodiments, at least one of $q_1$, $q_2$, $q_3$, $q_4$, $q_5$, $q_6$ and $q_7$ is methyl. In certain embodiments, modified THP nucleosides are provided wherein one of $R_1$ and $R_2$ is F. In certain embodiments, $R_1$ is F and $R_2$ is H, in certain embodiments, $R_1$ is methoxy and $R_2$ is H, and in certain embodiments, $R_1$ is methoxyethoxy and $R_2$ is H.

In certain embodiments, sugar surrogates comprise rings having more than 5 atoms and more than one heteroatom. For example, nucleosides comprising morpholino sugar moieties and their use in oligonucleotides have been reported (see, e.g., Braasch et al., Biochemistry, 2002, 41, 4503-4510 and Summerton et al., U.S. Pat. No. 5,698,685; Summerton et al., U.S. Pat. No. 5,166,315; Summerton et al., U.S. Pat. No. 5,185,444; and Summerton et al., U.S. Pat. No. 5,034,506). As used here, the term "morpholino" means a sugar surrogate having the following structure:

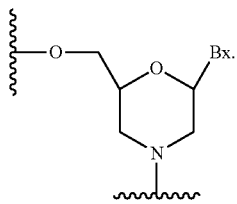

In certain embodiments, morpholinos may be modified, for example by adding or altering various substituent groups from the above morpholino structure. Such sugar surrogates are referred to herein as "modifed morpholinos."

In certain embodiments, sugar surrogates comprise acyclic moieites. Examples of nucleosides and oligonucleotides comprising such acyclic sugar surrogates include but are not limited to: peptide nucleic acid ("PNA"), acyclic butyl nucleic acid (see, e.g., Kumar et al., *Org. Biomol. Chem.*, 2013, 11, 5853-5865), and nucleosides and oligonucleotides described in Manoharan et al., WO2011/133876.

Many other bicyclic and tricyclic sugar and sugar surrogate ring systems are known in the art that can be used in modified nucleosides.

2. Certain Modified Nucleobases

In certain embodiments, modified oligonucleotides comprise one or more nucleosides comprising an unmodified nucleobase. In certain embodiments, modified oligonucleotides comprise one or more nucleosides comprising a modified nucleobase. In certain embodiments, modified oligonucleotides comprise one or more nucleosides that does not comprise a nucleobase, referred to as an abasic nucleoside.

In certain embodiments, modified nucleobases are selected from: 5-substituted pyrimidines, 6-azapyrimidines, alkyl or alkynyl substituted pyrimidines, alkyl substituted purines, and N-2, N-6 and O-6 substituted purines. In certain embodiments, modified nucleobases are selected from: 2-aminopropyladenine, 5-hydroxymethyl cytosine, xanthine, hypoxanthine, 2-aminoadenine, 6-N-methylguanine, 6-N-methyladenine, 2-propyladenine, 2-thiouracil, 2-thiothymine and 2-thiocytosine, 5-propynyl (—C≡C—CH$_3$) uracil, 5-propynylcytosine, 6-azouracil, 6-azocytosine, 6-azothymine, 5-ribosyluracil (pseudouracil), 4-thiouracil, 8-halo, 8-amino, 8-thiol, 8-thioalkyl, 8-hydroxyl, 8-aza and other 8-substituted purines, 5-halo, particularly 5-bromo, 5-trifluoromethyl, 5-halouracil, and 5-halocytosine, 7-methylguanine, 7-methyladenine, 2-F-adenine, 2-aminoadenine, 7-deazaguanine, 7-deazaadenine, 3-deazaguanine, 3-deazaadenine, 6-N-benzoyladenine, 2-N-isobutyrylguanine, 4-N-benzoylcytosine, 4-N-benzoyluracil, 5-methyl 4-N-benzoylcytosine, 5-methyl 4-N-benzoyluracil, universal bases, hydrophobic bases, promiscuous bases, size-expanded bases, and fluorinated bases. Further modified nucleobases include tricyclic pyrimidines, such as 1,3-diazaphenoxazine-2-one, 1,3-diazaphenothiazine-2-one and 9-(2-aminoethoxy)-1,3-diazaphenoxazine-2-one (G-clamp) Modified nucleobases may also include those in which the purine or pyrimidine base is replaced with other heterocycles, for example 7-deaza-adenine, 7-deazaguanosine, 2-aminopyridine and 2-pyridone. Further nucleobases include those disclosed in Merigan et al., U.S. Pat. No. 3,687,808, those disclosed in *The Concise Encyclopedia Of Polymer Science And Engineering*, Kroschwitz, J. I., Ed., John Wiley & Sons, 1990, 858-859; Englisch et al., *Angewandte Chemie*, International Edition, 1991, 30, 613; Sanghvi, Y.S., Chapter 15, *Antisense Research and Applications*, Crooke, S. T. and Lebleu, B., Eds., CRC Press, 1993, 273-288; and those disclosed in Chapters 6 and 15, *Antisense Drug Technology*, Crooke S. T., Ed., CRC Press, 2008, 163-166 and 442-443.

Publications that teach the preparation of certain of the above noted modified nucleobases as well as other modified nucleobases include without limitation, Manoharan et al., US2003/0158403; Manoharan et al., US2003/0175906; Dinh et al., U.S. Pat. No. 4,845,205; Spielvogel et al., U.S. Pat. No. 5,130,302; Rogers et al., U.S. Pat. No. 5,134,066; Bischofberger et al., U.S. Pat. No. 5,175,273; Urdea et al., U.S. Pat. No. 5,367,066; Benner et al., U.S. Pat. No. 5,432,272; Matteucci et al., U.S. Pat. No. 5,434,257; Gmeiner et al., U.S. Pat. No. 5,457,187; Cook et al., U.S. Pat. No. 5,459,255; Froehler et al., U.S. Pat. No. 5,484,908; Matteucci et al., U.S. Pat. No. 5,502,177; Hawkins et al., U.S. Pat. No. 5,525,711; Haralambidis et al., U.S. Pat. No. 5,552,540; Cook et al., U.S. Pat. No. 5,587,469; Froehler et al., U.S. Pat. No. 5,594,121; Switzer et al., U.S. Pat. No. 5,596,091; Cook et al., U.S. Pat. No. 5,614,617; Froehler et al., U.S. Pat. No. 5,645,985; Cook et al., U.S. Pat. No. 5,681,941; Cook et al., U.S. Pat. No. 5,811,534; Cook et al., U.S. Pat. No. 5,750,692; Cook et al., U.S. Pat. No. 5,948,903; Cook et al., U.S. Pat. No. 5,587,470; Cook et al., U.S. Pat. No. 5,457,191; Matteucci et al., U.S. Pat. No. 5,763,588; Froehler et al., U.S. Pat. No. 5,830,653; Cook et al., U.S. Pat. No. 5,808,027; Cook et al., U.S. Pat. No. 6,166,199; and Matteucci et al., U.S. Pat. No. 6,005,096.

3. Certain Modified Internucleoside Linkages

In certain embodiments, nucleosides of modified oligonucleotides may be linked together using any internucleoside linkage. The two main classes of internucleoside linking groups are defined by the presence or absence of a phosphorus atom. Representative phosphorus-containing internucleoside linkages include but are not limited to phosphodiesters, which contain a phosphodiester bond ("P(O$_2$)=O") (also referred to as unmodified or naturally occurring linkages), phosphotriesters, methylphosphonates, phosphoramidates, and phosphorothioates ("P(O$_2$)=S"), and phosphorodithioates ("HS-P=S"). Representative non-phosphorus containing internucleoside linking groups include but are not limited to methylenemethylimino (—CH$_2$—N(CH$_3$)—O—CH$_2$—), thiodiester, thionocarbamate (—O—C(=O)(NH)—S—); siloxane (—O—SH$_2$—O—); and N,N'-dimethylhydrazine (—CH$_2$—N(CH$_3$)—N(CH$_3$)—). Modified internucleoside linkages, compared to naturally occurring phosphate linkages, can be used to alter, typically increase, nuclease resistance of the oligonucleotide. In certain embodiments, internucleoside linkages having a chiral atom can be prepared as a racemic mixture, or as separate enantiomers. Methods of preparation of phosphorous-containing and non-phosphorous-containing internucleoside linkages are well known to those skilled in the art.

Representative internucleoside linkages having a chiral center include but are not limited to alkylphosphonates and phosphorothioates. Modified oligonucleotides comprising internucleoside linkages having a chiral center can be prepared as populations of modified oligonucleotides comprising stereorandom internucleoside linkages, or as populations of modified oligonucleotides comprising phosphorothioate linkages in particular stereochemical configurations. In certain embodiments, populations of modified oligonucleotides comprise phosphorothioate internucleoside linkages wherein all of the phosphorothioate internucleoside linkages are stereorandom. Such modified oligonucleotides can be generated using synthetic methods that result in random selection of the stereochemical configuration of each phosphorothioate linkage. Nonetheless, as is well understood by those of skill in the art, each individual phosphorothioate of each individual oligonucleotide molecule has a defined stereoconfiguration. In certain embodiments, populations of modified oligonucleotides are enriched for modified oligonucleotides comprising one or more particular phosphorothioate internucleoside linkages in a particular, independently selected stereochemical configuration. In certain embodiments, the particular configuration of the particular phosphorothioate linkage is present in at least 65% of the molecules in the population. In certain embodiments, the particular configuration of the particular phosphorothioate linkage is present in at least 70% of the molecules in the population. In certain embodiments, the particular configuration of the particular phosphorothioate linkage is present in at least 80% of the molecules in the population. In certain embodiments, the particular configuration of the particular phosphorothioate linkage is present in at least 90% of the molecules in the population. In certain embodiments, the particular configuration of the particular phosphorothioate linkage is present in at least 99% of the molecules in the population. Such chirally enriched populations of modified oligonucleotides can be generated using synthetic methods known in the art, e.g., methods described in Oka et al., *JACS* 125, 8307 (2003), Wan et al. *Nuc. Acid. Res.* 42, 13456 (2014), and WO 2017/015555. In certain embodiments, a population of modified oligonucleotides is enriched for modified oligonucleotides having at least one indicated phosphorothioate in the (Sp) configuration. In certain embodiments, a population of modified oligonucleotides is enriched for modified oligonucleotides having at least one phosphorothioate in the (Rp) configuration. In certain embodiments, modified oligonucleotides comprising (Rp) and/or (Sp) phosphorothioates comprise one or more of the following formulas, respectively, wherein "B" indicates a nucleobase:

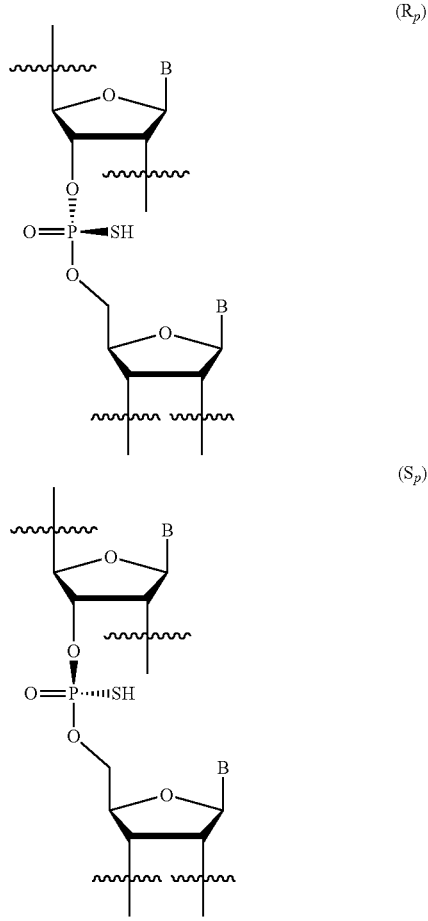

Unless otherwise indicated, chiral internucleoside linkages of modified oligonucleotides described herein can be stereorandom or in a particular stereochemical configuration.

Neutral internucleoside linkages include, without limitation, phosphotriesters, methylphosphonates, MMI (3'-CH$_2$—N(CH$_3$)—O-5'), amide-3 (3'-CH$_2$—C(=O)—N(H)-5'), amide-4 (3'-CH$_2$—N(H)—C(=O)-5'), formacetal (3'-O—CH$_2$—O—5'), methoxypropyl (MOP), and thioformacetal (3'-S—CH$_2$—O-5'). Further neutral internucleoside linkages include nonionic linkages comprising siloxane (dialkylsiloxane), carboxylate ester, carboxamide, sulfide, sulfonate ester and amides (See for example: *Carbohydrate Modifications in Antisense Research*; Y. S. Sanghvi and P. D. Cook, Eds., ACS Symposium Series 580; Chapters 3 and 4, 40-65). Further neutral internucleoside linkages include nonionic linkages comprising mixed N, O, S and CH$_2$ component parts.

B. Certain Motifs

In certain embodiments, modified oligonucleotides comprise one or more modified nucleosides comprising a modified sugar moiety. In certain embodiments, modified oligonucleotides comprise one or more modified nucleosides comprising a modified nucleobase. In certain embodiments, modified oligonucleotides comprise one or more modified internucleoside linkage. In such embodiments, the modified, unmodified, and differently modified sugar moieties, nucleobases, and/or internucleoside linkages of a modified oligonucleotide define a pattern or motif. In certain embodiments, the patterns of sugar moieties, nucleobases, and internucleoside linkages are each independent of one another. Thus, a modified oligonucleotide may be described by its sugar motif, nucleobase motif and/or internucleoside linkage motif (as used herein, nucleobase motif describes the modifications to the nucleobases independent of the sequence of nucleobases).

1. Certain Sugar Motifs

In certain embodiments, oligonucleotides comprise one or more type of modified sugar and/or unmodified sugar moiety arranged along the oligonucleotide or portion thereof in a defined pattern or sugar motif. In certain instances, such sugar motifs include but are not limited to any of the sugar modifications discussed herein.

In certain embodiments, modified oligonucleotides have a gapmer motif, which is defined by two external regions or "wings" and a central or internal region or "gap." The three regions of a gapmer motif (the 5'-wing, the gap, and the 3'-wing) form a contiguous sequence of nucleosides wherein at least some of the sugar moieties of the nucleosides of each of the wings differ from at least some of the sugar moieties of the nucleosides of the gap. Specifically, at least the sugar moieties of the nucleosides of each wing that are closest to the gap (the 3'-most nucleoside of the 5'-wing and the 5'-most nucleoside of the 3'-wing) differ from the sugar moiety of the neighboring gap nucleosides, thus defining the boundary between the wings and the gap (i.e., the wing/gap junction). In certain embodiments, the sugar moieties within the gap are the same as one another. In certain embodiments, the gap includes one or more nucleoside having a sugar moiety that differs from the sugar moiety of one or more other nucleosides of the gap. In certain embodiments, the sugar motifs of the two wings are the same as one another (symmetric gapmer). In certain embodiments, the sugar motif of the 5'-wing differs from the sugar motif of the 3'-wing (asymmetric gapmer).

In certain embodiments, the wings of a gapmer comprise 1-6 nucleosides. In certain embodiments, each nucleoside of each wing of a gapmer comprises a modified sugar moiety. In certain embodiments, at least one nucleoside of each wing of a gapmer comprises a modified sugar moiety. In certain embodiments, at least two nucleosides of each wing of a gapmer comprises a modified sugar moiety. In certain embodiments, at least three nucleosides of each wing of a gapmer comprises a modified sugar moiety. In certain embodiments, at least four nucleosides of each wing of a gapmer comprises a modified sugar moiety. In certain embodiments, at least five nucleosides of each wing of a gapmer comprises a modified sugar moiety.

In certain embodiments, the gap of a gapmer comprises 7-12 nucleosides. In certain embodiments, each nucleoside of the gap of a gapmer comprises a 2'-β-D-deoxyribosyl sugar moiety. In certain embodiments, at least one nucleoside of the gap of a gapmer comprises a modified sugar moiety.

In certain embodiments, the gapmer is a deoxy gapmer. In certain embodiments, the nucleosides on the gap side of each wing/gap junction comprise 2'- deoxyribosyl sugar moieties and the nucleosides on the wing sides of each wing/gap junction comprise modified sugar moieties. In certain embodiments, each nucleoside of the gap comprises a 2'-β-D-deoxyribosyl sugar moiety. In certain embodiments, each nucleoside of each wing of a gapmer comprises a modified sugar moiety. In certain embodiments, exactly one nucleoside of the gap comprises a modified sugar moiety and each remaining nucleoside of the gap comprises a 2'-β-D-deoxyribosyl sugar moiety.

In certain embodiments, modified oligonucleotides comprise or consist of a portion having a fully modified sugar motif. In such embodiments, each nucleoside of the fully modified portion of the modified oligonucleotide comprises a modified sugar moiety. In certain embodiments, each nucleoside of the entire modified oligonucleotide comprises a modified sugar moiety. In certain embodiments, modified oligonucleotides comprise or consist of a portion having a fully modified sugar motif, wherein each nucleoside within the fully modified portion comprises the same modified sugar moiety, referred to herein as a uniformly modified sugar motif. In certain embodiments, a fully modified oligonucleotide is a uniformly modified oligonucleotide. In certain embodiments, each nucleoside of a uniformly modified comprises the same 2'-modification.

Herein, the lengths (number of nucleosides) of the three regions of a gapmer may be provided using the notation [# of nucleosides in the 5'-wing]-[# of nucleosides in the gap]-[# of nucleosides in the 3'-wing]. Thus, a 3-10-3 gapmer consists of 3 linked nucleosides in each wing and 10 linked nucleosides in the gap. Where such nomenclature is followed by a specific modification, that modification is the modification in each sugar moiety of each wing and the gap nucleosides comprise 2'-β-D-deoxyribosyl sugar moieties. Thus, a 5-10-5 MOE gapmer consists of 5 linked 2'-MOE nucleosides in the 5'-wing, 10 linked 2'- β-D-deoxynucleosides in the gap, and 5 linked 2'-MOE nucleosides in the 3'-wing. A 3-10-3 cEt gapmer consists of 3 linked cEt nucleosides in the 5'-wing, 10 linked 2'- β-D-deoxynucleosides in the gap, and 3 linked cEt nucleosides in the 3'-wing. A 5-8-5 gapmer consists of 5 linked nucleosides comprising a modified sugar moiety in the 5'-wing, 8 linked 2'-β-D-deoxynucleosides in the gap, and 5 linked nucleosides comprising a modified sugar moiety in the 3'-wing. A 5-8-5 mixed gapmer has at least two different modified sugar moieties in the 5'- and/or the 3'-wing.

In certain embodiments, modified oligonucleotides are 5-10-5 MOE gapmers. In certain embodiments, modified oligonucleotides are 4-10-6 MOE gapmers. In certain embodiments, modified oligonucleotides are 6-10-4 MOE gapmers. In certain embodiments, modified oligonucleotides are 5-8-5 MOE gapmers. In certain embodiments, modified oligonucleotides are 6-8-4 MOE gapmers. In certain embodiments, modified oligonucleotides are 4-8-6 MOE gapmers. In certain embodiments, modified oligonucleotides are X-Y-Z MOE gapmers, wherein X and Z are independently selected from 1, 2, 3, 4, 5, or 6 and Y is 7, 8, 9, 10, or 11.

2. Certain Nucleobase Motifs

In certain embodiments, oligonucleotides comprise modified and/or unmodified nucleobases arranged along the oligonucleotide or portion thereof in a defined pattern or motif. In certain embodiments, each nucleobase is modified. In certain embodiments, none of the nucleobases are modified. In certain embodiments, each purine or each pyrimidine is modified. In certain embodiments, each adenine is modified. In certain embodiments, each guanine is modified. In certain embodiments, each thymine is modified. In certain embodiments, each uracil is modified. In certain embodiments, each cytosine is modified. In certain embodiments, some or all of the cytosine nucleobases in a modified oligonucleotide are 5-methyl cytosines. In certain embodiments, all of the cytosine nucleobases are 5-methyl cytosines and all of the other nucleobases of the modified oligonucleotide are unmodified nucleobases.

In certain embodiments, modified oligonucleotides comprise a block of modified nucleobases. In certain such embodiments, the block is at the 3'-end of the oligonucleotide. In certain embodiments the block is within 3 nucleosides of the 3'-end of the oligonucleotide. In certain embodiments, the block is at the 5'-end of the oligonucleotide. In certain embodiments the block is within 3 nucleosides of the 5'-end of the oligonucleotide.

In certain embodiments, oligonucleotides having a gapmer motif comprise a nucleoside comprising a modified nucleobase. In certain such embodiments, one nucleoside comprising a modified nucleobase is in the central gap of an oligonucleotide having a gapmer motif. In certain such embodiments, the sugar moiety of said nucleoside is a 2'-β-D-deoxyribosyl sugar moiety. In certain embodiments, the modified nucleobase is selected from: a 2-thiopyrimidine and a 5-propynepyrimidine.

3. Certain Internucleoside Linkage Motifs

In certain embodiments, oligonucleotides comprise modified and/or unmodified internucleoside linkages arranged along the oligonucleotide or portion thereof in a defined pattern or motif. In certain embodiments, each internucleoside linking group is a phosphodiester internucleoside linkage ($P(O_2)=O$). In certain embodiments, each internucleoside linking group of a modified oligonucleotide is a phosphorothioate internucleoside linkage ($P(O_2)=S$). In certain embodiments, each internucleoside linkage of a modified oligonucleotide is independently selected from a phosphorothioate internucleoside linkage and phosphodiester internucleoside linkage. In certain embodiments, each phosphorothioate internucleoside linkage is independently selected from a stereorandom phosphorothioate, a (Sp) phosphorothioate, and a (Rp) phosphorothioate. In certain embodiments, the sugar motif of a modified oligonucleotide is a gapmer and the internucleoside linkages within the gap are all modified. In certain such embodiments, some or all of the internucleoside linkages in the wings are unmodified phosphodiester internucleoside linkages. In certain embodiments, the terminal internucleoside linkages are modified. In certain embodiments, the sugar motif of a modified oligonucleotide is a gapmer, and the internucleoside linkage motif comprises at least one phosphodiester internucleoside linkage in at least one wing, wherein the at least one phosphodiester linkage is not a terminal internucleoside linkage, and the remaining internucleoside linkages are phosphorothioate internucleoside linkages. In certain such embodiments, all of the phosphorothioate linkages are stereorandom. In certain embodiments, all of the phosphorothioate linkages in the wings are (Sp) phosphorothioates, and the gap comprises at least one Sp, Sp, Rp motif. In certain embodiments, populations of modified oligonucleotides are enriched for modified oligonucleotides comprising such internucleoside linkage motifs.

In certain embodiments, modified nucleotides have an internucleoside linkage motif of soooosssssssssooss, wherein each "s" represents a phosphorothioate internucleoside linkage and each "o" represents a phosphodiester internucleoside linkage. In certain embodiments, modified nucleotides have an internucleoside linkage motif of soooosssssssssoss, wherein each "s" represents a phosphorothioate internucleoside linkage and each "o" represents a phosphodiester internucleoside linkage. In certain embodiments, modified nucleotides have an internucleoside linkage motif of soooossssssssssoss, wherein each "s" represents a phosphorothioate internucleoside linkage and each "o" represents a phosphodiester internucleoside linkage. In certain embodiments, modified nucleotides have an internucleoside linkage motif of sooossssssssssooss, wherein each "s" represents a phosphorothioate internucleoside linkage and each "o" represents a phosphodiester internucleoside linkage. In certain embodiments, modified nucleotides have an internucleoside linkage motif of sooossssssssssoooss, wherein each "s" represents a phosphorothioate internucleoside linkage and each "o" represents a phosphodiester internucleoside linkage. In certain embodiments, modified nucleotides have an internucleoside linkage motif of soossssssssssoooss, wherein each "s" represents a phosphorothioate internucleoside linkage and each "o" represents a phosphodiester internucleoside linkage.

C. Certain Lengths

It is possible to increase or decrease the length of an oligonucleotide without eliminating activity. For example, in Woolf et al. (Proc. Natl. Acad. Sci. USA 89:7305-7309, 1992), a series of oligonucleotides 13-25 nucleobases in length were tested for their ability to induce cleavage of a target RNA in an oocyte injection model. Oligonucleotides 25 nucleobases in length with 8 or 11 mismatch bases near the ends of the oligonucleotides were able to direct specific cleavage of the target RNA, albeit to a lesser extent than the oligonucleotides that contained no mismatches. Similarly, target specific cleavage was achieved using 13 nucleobase oligonucleotides, including those with 1 or 3 mismatches.

In certain embodiments, oligonucleotides (including modified oligonucleotides) can have any of a variety of ranges of lengths. In certain embodiments, oligonucleotides consist of X to Y linked nucleosides, where X represents the fewest number of nucleosides in the range and Y represents the largest number nucleosides in the range. In certain such embodiments, X and Y are each independently selected from 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, and 50; provided that X≤Y. For example, in certain embodiments, oligonucleotides consist of 12 to 13, 12 to 14, 12 to 15, 12 to 16, 12 to 17, 12 to 18, 12 to 19, 12 to 20, 12 to 21, 12 to 22, 12 to 23, 12 to 24, 12 to 25, 12 to 26, 12 to 27, 12 to 28, 12 to 29, 12 to 30, 13 to 14, 13 to 15, 13 to 16, 13 to 17, 13 to 18, 13 to 19, 13 to 20, 13 to 21, 13 to 22, 13 to 23, 13 to 24, 13 to 25, 13 to 26, 13 to 27, 13 to 28, 13 to 29, 13 to 30, 14 to 15, 14 to 16, 14 to 17, 14 to 18, 14 to 19, 14 to 20, 14 to 21, 14 to 22, 14 to 23, 14 to 24, 14 to 25, 14 to 26, 14 to 27, 14 to 28, 14 to 29, 14 to 30, 15 to 16, 15 to 17, 15 to 18, 15 to 19, 15 to 20, 15 to 21, 15 to 22, 15 to 23, 15 to 24, 15 to 25, 15 to 26, 15 to 27, 15 to 28, 15 to 29, 15 to 30, 16 to 17, 16 to 18, 16 to 19, 16 to 20, 16 to 21, 16 to 22, 16 to 23, 16 to 24, 16 to 25, 16 to 26, 16 to 27, 16 to 28, 16 to 29, 16 to 30, 17 to 18, 17 to 19, 17 to 20, 17 to 21, 17 to 22, 17 to 23, 17 to 24, 17 to 25, 17 to 26, 17 to 27, 17 to 28, 17 to 29, 17 to 30, 18 to 19, 18 to 20, 18 to 21, 18 to 22, 18 to 23, 18 to 24, 18 to 25, 18 to 26, 18 to 27, 18 to 28, 18 to 29, 18 to 30, 19 to 20, 19 to 21, 19 to 22, 19 to 23, 19 to 24, 19 to 25, 19 to 26, 19 to 29, 19 to 28, 19 to 29, 19 to 30, 20 to 21, 20 to 22, 20 to 23, 20 to 24, 20 to 25, 20 to 26, 20 to 27, 20 to 28, 20 to 29, 20 to 30, 21 to 22, 21 to 23, 21 to 24, 21 to 25, 21 to 26, 21 to 27, 21 to 28, 21 to 29, 21 to 30, 22 to 23, 22 to 24, 22 to 25, 22 to 26, 22 to 27, 22 to 28, 22 to 29, 22 to 30, 23 to 24, 23 to 25, 23 to 26, 23 to 27, 23 to 28, 23 to 29, 23 to 30, 24 to 25, 24 to 26, 24 to 27, 24 to 28, 24 to 29, 24 to 30, 25 to 26, 25 to 27, 25 to 28, 25 to 29, 25 to 30, 26 to 27, 26 to 28, 26 to 29, 26 to 30, 27 to 28, 27 to 29, 27 to 30, 28 to 29, 28 to 30, or 29 to 30 linked nucleosides.

D. Certain Modified Oligonucleotides

In certain embodiments, the above modifications (sugar, nucleobase, internucleoside linkage) are incorporated into a modified oligonucleotide. In certain embodiments, modified oligonucleotides are characterized by their modification motifs and overall lengths. In certain embodiments, such parameters are each independent of one another. Thus, unless otherwise indicated, each internucleoside linkage of an oligonucleotide having a gapmer sugar motif may be modified or unmodified and may or may not follow the gapmer modification pattern of the sugar modifications. For example, the internucleoside linkages within the wing regions of a sugar gapmer may be the same or different from one another and may be the same or different from the internucleoside linkages of the gap region of the sugar motif. Likewise, such sugar gapmer oligonucleotides may comprise one or more modified nucleobase independent of the gapmer pattern of the sugar modifications. Unless otherwise indicated, all modifications are independent of nucleobase sequence.

E. Certain Populations of Modified Oligonucleotides

Populations of modified oligonucleotides in which all of the modified oligonucleotides of the population have the same molecular formula can be stereorandom populations or chirally enriched populations. All of the chiral centers of all of the modified oligonucleotides are stereorandom in a stereorandom population. In a chirally enriched population, at least one particular chiral center is not stereorandom in the modified oligonucleotides of the population. In certain embodiments, the modified oligonucleotides of a chirally enriched population are enriched for β-D ribosyl sugar moieties, and all of the phosphorothioate internucleoside linkages are stereorandom. In certain embodiments, the modified oligonucleotides of a chirally enriched population are enriched for both β-D ribosyl sugar moieties and at least one, particular phosphorothioate internucleoside linkage in a particular stereochemical configuration.

F. Nucleobase Sequence

In certain embodiments, oligonucleotides (unmodified or modified oligonucleotides) are further described by their nucleobase sequence. In certain embodiments oligonucleotides have a nucleobase sequence that is complementary to a second oligonucleotide or an identified reference nucleic acid, such as a target nucleic acid. In certain such embodiments, a portion of an oligonucleotide has a nucleobase sequence that is complementary to a second oligonucleotide or an identified reference nucleic acid, such as a target nucleic acid. In certain embodiments, the nucleobase sequence of a portion or entire length of an oligonucleotide is at least 50%, at least 60%, at least 70%, at least 80%, at least 85%, at least 90%, at least 95%, or 100% complementary to the second oligonucleotide or nucleic acid, such as a target nucleic acid.

II. Certain Oligommic Compounds

In certain embodiments, provided herein are oligomeric compounds, which consist of an oligonucleotide (modified or unmodified) and optionally one or more conjugate groups and/or terminal groups. Conjugate groups consist of one or more conjugate moiety and a conjugate linker which links the conjugate moiety to the oligonucleotide. Conjugate groups may be attached to either or both ends of an oligonucleotide and/or at any internal position. In certain embodiments, conjugate groups are attached to the $2^1$-position of a nucleoside of a modified oligonucleotide. In certain embodiments, conjugate groups that are attached to either or both ends of an oligonucleotide are terminal groups. In certain such embodiments, conjugate groups or terminal groups are attached at the 3' and/or 5'-end of oligonucleotides. In certain such embodiments, conjugate groups (or terminal groups) are attached at the 3'-end of oligonucleotides. In certain embodiments, conjugate groups are attached near the 3'-end of oligonucleotides. In certain embodiments, conjugate groups (or terminal groups) are attached at the 5'-end of oligonucleotides. In certain embodiments, conjugate groups are attached near the 5'-end of oligonucleotides.

Examples of terminal groups include but are not limited to conjugate groups, capping groups, phosphate moieties, protecting groups, modified or unmodified nucleosides, and two or more nucleosides that are independently modified or unmodified.

A. Certain Conjugate Groups

In certain embodiments, oligonucleotides are covalently attached to one or more conjugate groups. In certain embodiments, conjugate groups modify one or more properties of the attached oligonucleotide, including but not limited to pharmacodynamics, pharmacokinetics, stability, binding, absorption, tissue distribution, cellular distribution, cellular uptake, charge and clearance. In certain embodiments, conjugate groups impart a new property on the attached oligonucleotide, e.g., fluorophores or reporter groups that enable detection of the oligonucleotide. Certain conjugate groups and conjugate moieties have been described previously, for example: cholesterol moiety (Letsinger et al., Proc. Natl. Acad. Sci. USA, 1989, 86, 6553-6556), cholic acid (Manoharan et al., *Bioorg. Med. Chem. Lett.*, 1994, 4, 1053-1060), a thioether, e.g., hexyl-S-tritylthiol (Manoharan et al., *Ann. N.Y. Acad. Sci.*, 1992, 660, 306-309; Manoharan et al., *Bioorg. Med. Chem. Lett.*, 1993, 3, 2765-2770), a thiocholesterol (Oberhauser et al., *Nucl. Acids Res.*, 1992, 20, 533-538), an aliphatic chain, e g., do-decan-diol or undecyl residues (Saison-Behmoaras et al., *EMBO J.*, 1991, 10, 1111-1118; Kabanov et al., FEBS Lett., 1990, 259, 327-330; Svinarchuk et al., *Biochimie*, 1993, 75, 49-54), a phospholipid, e.g., di-hexadecyl-rac-glycerol or triethyl-ammonium 1,2-di-O-hexadecyl-rac-glycero-3-H-phosphonate (Manoharan et al., *Tetrahedron Lett.*, 1995, 36, 3651-3654; Shea et al., *Nucl. Acids Res.*, 1990, 18, 3777-3783), a polyamine or a polyethylene glycol chain (Manoharan et al., *Nucleosides & Nucleotides*, 1995, 14, 969-973), or adamantane acetic acid a palmityl moiety (Mishra et al., *Biochim. Biophys. Acta*, 1995, 1264, 229-237), an octadecylamine or hexylamino-cathonyl-oxycholesterol moiety (Crooke et al., *J. Pharmacol. Exp. Ther.*, 1996, 277, 923-937), a tocopherol group (Nishina et al., *Molecular Therapy Nucleic Acids*, 2015, 4, e220; and Nishina et al., *Molecular Therapy*, 2008, 16, 734-740), or a GalNAc cluster (e.g., WO2014/179620).

In certain embodiments, conjugate groups may be selected from any of a C22 alkyl, C20 alkyl, C16 alkyl, C10 alkyl, C21 alkyl, C19 alkyl, C18 alkyl, C15 alkyl, C14 alkyl, C13 alkyl, $C_{12}$ alkyl, C11 alkyl, C9 alkyl, C8 alkyl, C7 alkyl, C6 alkyl, C5 alkyl, C22 alkenyl, C20 alkenyl, C16 alkenyl, C10 alkenyl, C21 alkenyl, C19 alkenyl, C18 alkenyl, C15 alkenyl, C14 alkenyl, C13 alkenyl, $C_{12}$ alkenyl, C11 alkenyl, C9 alkenyl, C8 alkenyl, C7 alkenyl, C6 alkenyl, or C5 alkenyl.

In certain embodiments, conjugate groups may be selected from any of C22 alkyl, C20 alkyl, C16 alkyl, C10 alkyl, C21 alkyl, C19 alkyl, C18 alkyl, C15 alkyl, C14 alkyl, C13 alkyl, $C_{12}$ alkyl, C11 alkyl, C9 alkyl, C8 alkyl, C7 alkyl, C6 alkyl, and C5 alkyl, where the alkyl chain has one or more unsaturated bonds.

1. Conjugate Moieties

Conjugate moieties include, without limitation, intercalators, reporter molecules, polyamines, polyamides, peptides, carbohydrates, vitamin moieties, polyethylene glycols, thioethers, polyethers, cholesterols, thiocholesterols, cholic acid moieties, folate, lipids, phospholipids, biotin, phenazine, phenanthridine, anthraquinone, adamantane, acridine, fluoresceins, rhodamines, coumarins, fluorophores, and dyes.

In certain embodiments, a conjugate moiety comprises an active drug substance, for example, aspirin, warfarin, phenylbutazone, ibuprofen, suprofen, fen-bufen, ketoprofen, (S)-(+)-pranoprofen, carprofen, dansylsarcosine, 2,3,5-triiodobenzoic acid, fingolimod, flufenamic acid, folinic acid, a benzothiadiazide, chlorothiazide, a diazepine, indomethicin, a barbiturate, a cephalosporin, a sulfa drug, an antidiabetic, an antibacterial or an antibiotic.

2. Conjugate Linkers

Conjugate moieties are attached to oligonucleotides through conjugate linkers. In certain oligomeric compounds, the conjugate linker is a single chemical bond (i.e., the conjugate moiety is attached directly to an oligonucleotide through a single bond). In certain embodiments, the conjugate linker comprises a chain structure, such as a hydrocarbyl chain, or an oligomer of repeating units such as ethylene glycol, nucleosides, or amino acid units.

In certain embodiments, a conjugate linker comprises one or more groups selected from alkyl, amino, oxo, amide, disulfide, polyethylene glycol, ether, thioether, and hydroxylamino. In certain such embodiments, the conjugate linker comprises groups selected from alkyl, amino, oxo, amide and ether groups. In certain embodiments, the conjugate linker comprises groups selected from alkyl and amide groups. In certain embodiments, the conjugate linker comprises groups selected from alkyl and ether groups. In certain embodiments, the conjugate linker comprises at least one phosphorus moiety. In certain embodiments, the conjugate linker comprises at least one phosphate group. In certain embodiments, the conjugate linker includes at least one neutral linking group.

In certain embodiments, conjugate linkers, including the conjugate linkers described above, are bifunctional linking moieties, e.g., those known in the art to be useful for attaching conjugate groups to parent compounds, such as the oligonucleotides provided herein. In general, a bifunctional linking moiety comprises at least two functional groups. One of the functional groups is selected to bind to a particular site on a parent compound and the other is selected to bind to a conjugate group. Examples of functional groups used in a bifunctional linking moiety include but are not limited to electrophiles for reacting with nucleophilic groups and nucleophiles for reacting with electrophilic groups. In certain embodiments, bifunctional linking moieties comprise one or more groups selected from amino, hydroxyl, carboxylic acid, thiol, alkyl, alkenyl, and alkynyl.

Examples of conjugate linkers include but are not limited to pyrrolidine, 8-amino-3,6-dioxaoctanoic acid (ADO), succinimidyl 4-(N-maleimidomethyl) cyclohexane-l-calboxylate (SMCC) and 6-aminohexanoic acid (AHEX or AHA). Other conjugate linkers include but are not limited to substituted or unsubstituted $C_1$-$C_{10}$ alkyl, substituted or unsubstituted $C_2$-$C_{10}$ alkenyl or substituted or unsubstituted $C_2$-$C_{10}$ alkynyl, wherein a nonlimiting list of preferred substituent groups includes hydroxyl, amino, alkoxy, carboxy, benzyl, phenyl, nitro, thiol, thioalkoxy, halogen, alkyl, aryl, alkenyl and alkynyl.

In certain embodiments, conjugate linkers comprise 1-10 linker-nucleosides. In certain embodiments, conjugate linkers comprise 2-5 linker-nucleosides. In certain embodiments, conjugate linkers comprise exactly 3 linker-nucleosides. In certain embodiments, conjugate linkers comprise the TCA motif. In certain embodiments, such linker-nucleosides are modified nucleosides. In certain embodiments such linker-nucleosides comprise a modified sugar moiety. In certain embodiments, linker-nucleosides are unmodified. In certain embodiments, linker-nucleosides comprise an optionally protected heterocyclic base selected from a purine, substituted purine, pyrimidine or substituted pyrimidine. In certain embodiments, a cleavable moiety is a nucleoside selected from uracil, thymine, cytosine, 4-N-benzoylcytosine, 5-methyl cytosine, 4-N-benzoyl-5-methyl cytosine, adenine, 6-N-benzoyladenine, guanine and 2-N-isobutyrylguanine. It is typically desirable for linker-nucleosides to be cleaved from the oligomeric compound after it reaches a target tissue. Accordingly, linker-nucleosides are typically linked to one another and to the remainder of the oligomeric compound through cleavable bonds. In certain embodiments, such cleavable bonds are phosphodiester bonds.

Herein, linker-nucleosides are not considered to be part of the oligonucleotide. Accordingly, in embodiments in which an oligomeric compound comprises an oligonucleotide consisting of a specified number or range of linked nucleosides and/or a specified percent complementarity to a reference nucleic acid and the oligomeric compound also comprises a conjugate group comprising a conjugate linker comprising linker-nucleosides, those linker-nucleosides are not counted toward the length of the oligonucleotide and are not used in determining the percent complementarity of the oligonucleotide for the reference nucleic acid. For example, an oligomeric compound may comprise (1) a modified oligonucleotide consisting of 8-30 nucleosides and (2) a conjugate group comprising 1-10 linker-nucleosides that are contiguous with the nucleosides of the modified oligonucleotide. The total number of contiguous linked nucleosides in such an oligomeric compound is more than 30. Alternatively, an oligomeric compound may comprise a modified oligonucleotide consisting of 8-30 nucleosides and no conjugate group. The total number of contiguous linked nucleosides in such an oligomeric compound is no more than 30. Unless otherwise indicated conjugate linkers comprise no more than 10 linker-nucleosides. In certain embodiments, conjugate linkers comprise no more than 5 linker-nucleosides. In certain embodiments, conjugate linkers comprise no more than 3 linker-nucleosides. In certain embodiments, conjugate linkers comprise no more than 2 linker-nucleosides. In certain embodiments, conjugate linkers comprise no more than 1 linker-nucleoside.

In certain embodiments, it is desirable for a conjugate group to be cleaved from the oligonucleotide. For example, in certain circumstances oligomeric compounds comprising a particular conjugate moiety are better taken up by a particular cell type, but once the oligomeric compound has been taken up, it is desirable that the conjugate group be cleaved to release the unconjugated or parent oligonucleotide. Thus, certain conjugate linkers may comprise one or more cleavable moieties. In certain embodiments, a cleavable moiety is a cleavable bond. In certain embodiments, a cleavable moiety is a group of atoms comprising at least one cleavable bond. In certain embodiments, a cleavable moiety comprises a group of atoms having one, two, three, four, or more than four cleavable bonds. In certain embodiments, a cleavable moiety is selectively cleaved inside a cell or subcellular compartment, such as a lysosome. In certain embodiments, a cleavable moiety is selectively cleaved by endogenous enzymes, such as nucleases.

In certain embodiments, a cleavable bond is selected from among: an amide, an ester, an ether, one or both esters of a phosphodiester, a phosphate ester, a carbamate, or a disulfide. In certain embodiments, a cleavable bond is one or both of the esters of a phosphodiester. In certain embodiments, a cleavable moiety comprises a phosphate or phosphodiester. In certain embodiments, the cleavable moiety is a phosphate or phosphodiester linkage between an oligonucleotide and a conjugate moiety or conjugate group.

In certain embodiments, a cleavable moiety comprises or consists of one or more linker-nucleosides. In certain such embodiments, the one or more linker-nucleosides are linked to one another and/or to the remainder of the oligomeric compound through cleavable bonds. In certain embodiments, such cleavable bonds are unmodified phosphodiester bonds. In certain embodiments, a cleavable moiety is 2'-deoxynucleoside that is attached to either the 3' or 5'-terminal nucleoside of an oligonucleotide by a phosphodiester internucleoside linkage and covalently attached to the remainder of the conjugate linker or conjugate moiety by a phosphate or phosphorothioate linkage. In certain such embodiments, the cleavable moiety is 2'-deoxyadenosine.

3. Cell-Targeting Moieties

In certain embodiments, a conjugate group comprises a cell-targeting moiety. In certain embodiments, a conjugate group has the general formula:

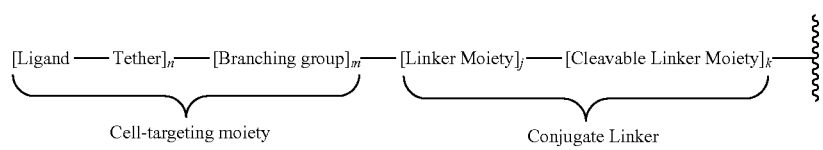

wherein n is from Ito about 3, m is 0 when n is 1, m is 1 when n is 2 or greater, j is 1 or 0, and k is 1 or 0.

In certain embodiments, n is 1, j is 1 and k is 0. In certain embodiments, n is 1, j is 0 and k is 1. In certain embodiments, n is 1, j is 1 and k is 1. In certain embodiments, n is 2, j is 1 and k is 0. In certain embodiments, n is 2, j is 0 and k is 1. In certain embodiments, n is 2, j is 1 and k is 1. In certain embodiments, n is 3, j is 1 and k is 0. In certain embodiments, n is 3, j is 0 and k is 1. In certain embodiments, n is 3, j is 1 and k is 1.

In certain embodiments, conjugate groups comprise cell-targeting moieties that have at least one tethered ligand In certain embodiments, cell-targeting moieties comprise two tethered ligands covalently attached to a branching group. In certain embodiments, cell-targeting moieties comprise three tethered ligands covalently attached to a branching group.

B. Certain Terminal Groups

In certain embodiments, oligomeric compounds comprise one or more terminal groups. In certain such embodiments, oligomeric compounds comprise a stabilized 5'-phosphate. Stabilized 5'-phosphates include, but are not limited to 5'-phosphanates, including, but not limited to 5'-vinylphosphonates. In certain embodiments, terminal groups comprise one or more abasic nucleosides and/or inverted nucleosides. In certain embodiments, terminal groups comprise one or more 2'-linked nucleosides. In certain such embodiments, the 2'-linked nucleoside is an abasic nucleoside.

III. Oligomeric Duplexes

In certain embodiments, oligomeric compounds described herein comprise an oligonucleotide, having a nucleobase sequence complementary to that of a target nucleic acid. In certain embodiments, an oligomeric compound is paired with a second oligomeric compound to form an oligomeric duplex. Such oligomeric duplexes comprise a first oligomeric compound having a portion complementary to a target nucleic acid and a second oligomeric compound having a portion complementary to the first oligomeric compound. In certain embodiments, the first oligomeric compound of an oligomeric duplex comprises or consists of (1) a modified or unmodified oligonucleotide and optionally a conjugate group and (2) a second modified or unmodified oligonucleotide and optionally a conjugate group. Either or both oligomeric compounds of an oligomeric duplex may comprise a conjugate group. The oligonucleotides of each oligomeric compound of an oligomeric duplex may include non-complementary overhanging nucleosides.

IV. Antisense Activity

In certain embodiments, oligomeric compounds and oligomeric duplexes are capable of hybridizing to a target nucleic acid, resulting in at least one antisense activity; such oligomeric compounds and oligomeric duplexes are antisense compounds. In certain embodiments, antisense compounds have antisense activity when they reduce or inhibit the amount or activity of a target nucleic acid by 25% or more in the standard cell assay. In certain embodiments, antisense compounds selectively affect one or more target nucleic acid. Such antisense compounds comprise a nucleobase sequence that hybridizes to one or more target nucleic acid, resulting in one or more desired antisense activity and does not hybridize to one or more non-target nucleic acid or does not hybridize to one or more non-target nucleic acid in such a way that results in significant undesired antisense activity.

In certain antisense activities, hybridization of an antisense compound to a target nucleic acid results in recruitment of a protein that cleaves the target nucleic acid. For example, certain antisense compounds result in RNase H mediated cleavage of the target nucleic acid. RNase H is a cellular endonuclease that cleaves the RNA strand of an RNA:DNA duplex. The DNA in such an RNA:DNA duplex need not be unmodified DNA. In certain embodiments, described herein are antisense compounds that are sufficiently "DNA-like" to elicit RNase H activity. In certain embodiments, one or more non-DNA-like nucleoside in the gap of a gapmer is tolerated.

In certain antisense activities, an antisense compound or a portion of an antisense compound is loaded into an RNA-induced silencing complex (RISC), ultimately resulting in cleavage of the target nucleic acid. For example, certain antisense compounds result in cleavage of the target nucleic acid by Argonaute Antisense compounds that are loaded into RISC are $RNAJ_1$ compounds. $RNAJ_1$ compounds may be double-stranded (siRNA) or single-stranded (ssRNA).

In certain embodiments, hybridization of an antisense compound to a target nucleic acid does not result in recruitment of a protein that cleaves that target nucleic acid. In certain embodiments, hybridization of the antisense compound to the target nucleic acid results in alteration of splicing of the target nucleic acid. In certain embodiments, hybridization of an antisense compound to a target nucleic acid results in inhibition of a binding interaction between the target nucleic acid and a protein or other nucleic acid. In certain embodiments, hybridization of an antisense compound to a target nucleic acid results in alteration of translation of the target nucleic acid.

Antisense activities may be observed directly or indirectly. In certain embodiments, observation or detection of an antisense activity involves observation or detection of a change in an amount of a target nucleic acid or protein encoded by such target nucleic acid, a change in the ratio of splice variants of a nucleic acid or protein and/or a phenotypic change in a cell or subject.

V. Certain Target Nucleic Acids

In certain embodiments, oligomeric compounds comprise or consist of an oligonucleotide comprising a portion that is complementary to a target nucleic acid. In certain embodiments, the target nucleic acid is an endogenous RNA molecule. In certain embodiments, the target nucleic acid encodes a protein. In certain such embodiments, the target nucleic acid is selected from: an endogenous antisense transcript that does not encode a protein (e.g., UBE3A-ATS), a mature mRNA, and a pre-mRNA, including intronic, exonic and untranslated regions. In certain embodiments, the target RNA is an antisense transcript. In certain embodiments, the target RNA is a mature mRNA. In certain embodiments, the target nucleic acid is a pre-mRNA. In certain such embodiments, the target region is entirely within an intron. In certain embodiments, the target region spans an intron/exon junction. In certain embodiments, the target region is at least 50% within an intron. In certain embodiments, the target nucleic acid is the RNA transcriptional product of a retrogene. In certain embodiments, the target nucleic acid is a non-coding RNA. In certain such embodiments, the target non-coding RNA is selected from: a long non-coding RNA, a short non-coding RNA, an intronic RNA molecule.

A. Complementarity/Mismatches to the Target Nucleic Acid

It is possible to introduce mismatch bases without eliminating activity. For example, Gautschi et al (J. Natl. Cancer Inst. 93:463-471, March 2001) demonstrated the ability of an oligonucleotide having 100% complementarity to the bcl-2 mRNA and having 3 mismatches to the bcl-xL mRNA to reduce the expression of both bcl-2 and bcl-xL in vitro and in vivo. Furthermore, this oligonucleotide demonstrated potent anti-tumor activity in vivo. Maher and Dolnick (Nuc. Acid. Res. 16:3341-3358, 1988) tested a series of tandem 14 nucleobase oligonucleotides, and 28 and 42 nucleobase oligonucleotides comprised of the sequence of two or three of the tandem oligonucleotides, respectively, for their ability to arrest translation of human DHFR in a rabbit reticulocyte assay. Each of the three 14 nucleobase oligonucleotides alone was able to inhibit translation, albeit at a more modest level than the 28 or 42 nucleobase oligonucleotides.

In certain embodiments, oligonucleotides are complementary to the target nucleic acid over the entire length of the oligonucleotide. In certain embodiments, oligonucleotides are 99%, 95%, 90%, 85%, or 80% complementary to the target nucleic acid. In certain embodiments, oligonucleotides are at least 80% complementary to the target nucleic acid over the entire length of the oligonucleotide and comprise a portion that is 100% or fully complementary to a target nucleic acid. In certain embodiments, the portion of full complementarity is 6, 7, 8, 9, 10, 11, 12, 13, 14, 15, 16, 17, 18, 19, 20, 21, 22, 23, or 24 nucleobases in length.

In certain embodiments, oligonucleotides comprise one or more mismatched nucleobases relative to the target nucleic acid. In certain embodiments, antisense activity against the target is reduced by such mismatch, but activity against a non-target is reduced by a greater amount. Thus, in certain embodiments selectivity of the oligonucleotide is improved. In certain embodiments, the mismatch is specifically positioned within an oligonucleotide having a gapmer motif. In certain embodiments, the mismatch is at position 1, 2, 3, 4, 5, 6, 7, or 8 from the 5'-end of the gap region. In certain embodiments, the mismatch is at position 9, 8, 7, 6, 5, 4, 3, 2, 1 from the 3'-end of the gap region. In certain embodiments, the mismatch is at position 1, 2, 3, or 4 from the 5'-end of the wing region. In certain embodiments, the mismatch is at position 4, 3, 2, or 1 from the 3'-end of the wing region.

B. UBE3A-ATS

In certain embodiments, oligomeric compounds comprise or consist of an oligonucleotide, or portion thereof, that is complementary to a target nucleic acid, wherein the target nucleic acid is UBE3A-ATS. In certain embodiments, UBE3A-ATS nucleic acid has the sequence set forth in SEQ ID NO: 1 (GENBANK Accession No: NC_000015.10_TRUNC_24821647_25441028), SEQ ID NO: 2915 (Ensemble Gene ID ENSG00000224078), or SEQ ID NO: 2916 (the cDNA of Ensemble transcript ENST00000554726.1).

In certain embodiments, an oligomeric compound complementary to SEQ ID NO: 1, SEQ ID NO: 2915, or SEQ ID NO: 2916 is capable of reducing UBE3A-ATS in a cell. In certain embodiments, an oligomeric compound complementary to SEQ ID NO: 1 is capable of increasing UBE3A RNA or protein in a cell. In certain embodiments, an oligomeric compound complementary to SEQ ID NO: 1, SEQ ID NO: 2915, or SEQ ID NO: 2916 is capable of increasing paternal UBE3A RNA or protein in a cell. In certain embodiments, the cell is in vitro. In certain embodiments, the cell is in a subject. In certain embodiments, the oligomeric compound consists of a modified oligonucleotide. In certain embodiments, an oligomeric compound complementary to SEQ ID NO: 1, SEQ ID NO: 2915, or SEQ ID NO: 2916 is capable of ameliorating one or more symptom or hallmark of a neurogenetic disorder when administered to a subject. In certain embodiments, the neurogenetic disorder is AS. In certain embodiments, the symptoms or hallmarks are selected from developmental delays, ataxia, speech impairment, sleep problems, seizures, and EEG abnormalities.

In certain embodiments, an oligomeric compound complementary to SEQ ID NO: 1, SEQ ID NO: 2915, or SEQ ID NO: 2916 is capable of reducing the detectable amount of UBE3A-ATS RNA in vitro by at least 10%, at least 20%, at least 30%, at least 40%, at least 50%, at least 60%, at least 70%, at least 80%, or at least 90%. In certain embodiments, an oligomeric compound complementary to SEQ ID NO: 1, SEQ ID NO: 2915, or SEQ ID NO: 2916 is capable of increasing the detectable amount of UBE3A protein in vitro by at least 10%, at least 20%, at least 30%, at least 40%, at least 50%, at least 60%, at least 70%, at least 80%, or at least 90%. In certain embodiments, an oligomeric compound complementary to SEQ ID NO: 1, SEQ ID NO: 2915, or SEQ ID NO: 2916 is capable of reducing the detectable amount of UBE3A-ATS RNA in the CSF of a subject by at least 10%, at least 20%, at least 30%, at least 40%, at least 50%, at least 60%, at least 70%, at least 80%, or at least 90%. In certain embodiments, an oligomeric compound complementary to SEQ ID NO: 1, SEQ ID NO: 2915, or SEQ ID NO: 2916 is capable of increasing the detectable amount of UBE3A protein in the CSF of a subject by at least 10%, at least 20%, at least 30%, at least 40%, at least 50%, at least 60%, at least 70%, at least 80%, or at least 90%.

C. Certain Target Nucleic Acids in Certain Tissues

In certain embodiments, oligomeric compounds comprise or consist of an oligonucleotide comprising a portion that is complementary to a target nucleic acid, wherein the target nucleic acid is expressed in a pharmacologically relevant tissue. In certain embodiments, the pharmacologically relevant tissues are the cells and tissues that comprise the central nervous system. Such tissues include the cortex, hippocampus, and spinal cord.

VI. Certain Pharmaceutical Compositions

In certain embodiments, described herein are pharmaceutical compositions comprising one or more oligomeric compounds. In certain embodiments, the one or more oligomeric compounds each consists of a modified oligonucleotide. In certain embodiments, the pharmaceutical composition comprises a pharmaceutically acceptable diluent or carrier. In certain embodiments, a pharmaceutical composition comprises or consists of a sterile saline solution and one or more oligomeric compound. In certain embodiments, the sterile saline is pharmaceutical grade saline. In certain embodiments, a pharmaceutical composition comprises or consists of one or more oligomeric compound and sterile water. In certain embodiments, the sterile water is pharmaceutical grade water. In certain embodiments, a pharmaceutical composition comprises or consists of one or more oligomeric compound and phosphate-buffered saline (PBS). In certain embodiments, the sterile PBS is pharmaceutical grade PBS. In certain embodiments, a pharmaceutical composition comprises or consists of one or more oligomeric compound and artificial cerebrospinal fluid. In certain embodiments, the artificial cerebrospinal fluid is pharmaceutical grade.

In certain embodiments, a pharmaceutical composition comprises a modified oligonucleotide and artificial cerebrospinal fluid. In certain embodiments, a pharmaceutical composition consists of a modified oligonucleotide and artificial cerebrospinal fluid. In certain embodiments, a pharmaceutical composition consists essentially of a modified oligonucleotide and artificial cerebrospinal fluid. In certain embodiments, the artificial cerebrospinal fluid is pharmaceutical grade.

In certain embodiments, pharmaceutical compositions comprise one or more oligomeric compound and one or more excipients. In certain embodiments, excipients are selected from water, salt solutions, alcohol, polyethylene glycols, gelatin, lactose, amylase, magnesium stearate, talc, silicic acid, viscous paraffin, hydroxymethylcellulose and polyvinylpyrrolidone.

In certain embodiments, oligomeric compounds may be admixed with pharmaceutically acceptable active and/or inert substances for the preparation of pharmaceutical compositions or formulations. Compositions and methods for the formulation of pharmaceutical compositions depend on a number of criteria, including, but not limited to, route of administration, extent of disease, or dose to be administered.

In certain embodiments, pharmaceutical compositions comprising an oligomeric compound encompass any pharmaceutically acceptable salts of the oligomeric compound, esters of the oligomeric compound, or salts of such esters. In certain embodiments, pharmaceutical compositions comprising oligomeric compounds comprising one or more oligonucleotide, upon administration to a subject, including a human, are capable of providing (directly or indirectly) the biologically active metabolite or residue thereof. Accordingly, for example, the disclosure is also drawn to pharmaceutically acceptable salts of oligomeric compounds, prodrugs, pharmaceutically acceptable salts of such prodrugs, and other bioequivalents. Suitable pharmaceutically acceptable salts include, but are not limited to, sodium and potassium salts. In certain embodiments, prodrugs comprise one or more conjugate group attached to an oligonucleotide, wherein the conjugate group is cleaved by endogenous nucleases within the body.

Lipid moieties have been used in nucleic acid therapies in a variety of methods. In certain such methods, the nucleic acid, such as an oligomeric compound, is introduced into preformed liposomes or lipoplexes made of mixtures of cationic lipids and neutral lipids. In certain methods, DNA complexes with mono- or poly-cationic lipids are formed without the presence of a neutral lipid. In certain embodiments, a lipid moiety is selected to increase distribution of a pharmaceutical agent to a particular cell or tissue. In certain embodiments, a lipid moiety is selected to increase distribution of a pharmaceutical agent to fat tissue. In certain embodiments, a lipid moiety is selected to increase distribution of a pharmaceutical agent to muscle tissue.

In certain embodiments, pharmaceutical compositions comprise a delivery system. Examples of delivery systems include, but are not limited to, liposomes and emulsions. Certain delivery systems are useful for preparing certain pharmaceutical compositions including those comprising hydrophobic compounds. In certain embodiments, certain organic solvents such as dimethylsulfoxide are used.

In certain embodiments, pharmaceutical compositions comprise one or more tissue-specific delivery molecules designed to deliver the one or more pharmaceutical agents of the present invention to specific tissues or cell types. For example, in certain embodiments, pharmaceutical compositions include liposomes coated with a tissue-specific antibody.

In certain embodiments, pharmaceutical compositions comprise a co-solvent system. Certain of such co-solvent systems comprise, for example, benzyl alcohol, a nonpolar surfactant, a water-miscible organic polymer, and an aqueous phase. In certain embodiments, such co-solvent systems are used for hydrophobic compounds. A non-limiting example of such a co-solvent system is the VPD co-solvent system, which is a solution of absolute ethanol comprising 3% w/v benzyl alcohol, 8% w/v of the nonpolar surfactant Polysorbate 80™ and 65% w/v polyethylene glycol 300. The proportions of such co-solvent systems may be varied considerably without significantly altering their solubility and toxicity characteristics. Furthermore, the identity of co-solvent components may be varied: for example, other surfactants may be used instead of Polysorbate 80™; the fraction size of polyethylene glycol may be varied; other biocompatible polymers may replace polyethylene glycol, e.g., polyvinyl pyrrolidone; and other sugars or polysaccharides may substitute for dextrose.

In certain embodiments, pharmaceutical compositions are prepared for oral administration. In certain embodiments, pharmaceutical compositions are prepared for buccal administration. In certain embodiments, a pharmaceutical composition is prepared for administration by injection (e.g., intravenous, subcutaneous, intramuscular, intrathecal (IT), intracerebroventricular (ICV), etc.). In certain of such embodiments, a pharmaceutical composition comprises a carrier and is formulated in aqueous solution, such as water or physiologically compatible buffers such as Hanks's solution, Ringer's solution, or physiological saline buffer. In certain embodiments, other ingredients are included (e.g., ingredients that aid in solubility or serve as preservatives). In certain embodiments, injectable suspensions are prepared using appropriate liquid carriers, suspending agents and the like. Certain pharmaceutical compositions for injection are presented in unit dosage form, e.g., in ampoules or in multi-dose containers. Certain pharmaceutical compositions for injection are suspensions, solutions or emulsions in oily or aqueous vehicles, and may contain formulatory agents such as suspending, stabilizing and/or dispersing agents. Certain solvents suitable for use in pharmaceutical compositions for injection include, but are not limited to, lipophilic solvents and fatty oils, such as sesame oil, synthetic fatty acid esters, such as ethyl oleate or triglycerides, and liposomes.

Under certain conditions, certain compounds disclosed herein act as acids. Although such compounds may be drawn or described in protonated (free acid) form, or ionized and in association with a cation (salt) form, aqueous solutions of such compounds exist in equilibrium among such forms. For example, a phosphate linkage of an oligonucleotide in aqueous solution exists in equilibrium among free acid, anion and salt forms. Unless otherwise indicated, compounds described herein are intended to include all such forms. Moreover, certain oligonucleotides have several such linkages, each of which is in equilibrium. Thus, oligonucleotides in solution exist in an ensemble of forms at multiple positions all at equilibrium. The term "oligonucleotide" is intended to include all such forms. Drawn structures necessarily depict a single form. Nevertheless, unless otherwise indicated, such drawings are likewise intended to include corresponding forms. Herein, a structure depicting the free acid of a compound followed by the term "or a salt thereof" expressly includes all such forms that may be fully or partially protonated/de-protonated/in association with a cation. In certain instances, one or more specific cation is identified.

In certain embodiments, modified oligonucleotides or oligomeric compounds are in aqueous solution with sodium. In certain embodiments, modified oligonucleotides or oligomeric compounds are in aqueous solution with potassium. In certain embodiments, modified oligonucleotides or oligomeric compounds are in PBS. In certain embodiments, modified oligonucleotides or oligomeric compounds are in water. In certain such embodiments, the pH of the solution is adjusted with NaOH and/or HCl to achieve a desired pH.

Herein, certain specific doses are described. A dose may be in the form of a dosage unit. For clarity, a dose (or dosage unit) of a modified oligonucleotide or an oligomeric compound in milligrams indicates the mass of the free acid form of the modified oligonucleotide or oligomeric compound. As described above, in aqueous solution, the free acid is in equilibrium with anionic and salt forms. However, for the purpose of calculating dose, it is assumed that the modified oligonucleotide or oligomeric compound exists as a solvent-free, sodium-acetate free, anhydrous, free acid. For example, where a modified oligonucleotide or an oligomeric compound is in solution comprising sodium (e.g., saline), the modified oligonucleotide or oligomeric compound may be partially or fully de-protonated and in association with Na+ions. However, the mass of the protons is nevertheless counted toward the weight of the dose, and the mass of the Na+ions are not counted toward the weight of the dose. Thus, for example, a dose, or dosage unit, of 100 mg of Compound No. 1263518 equals the number of fully protonated molecules that weighs 100 mg. This would be equivalent to 106 mg of solvent-free, sodium-acetate free, anhydrous sodiated Compound No. 1263518. When an oligomeric compound comprises a conjugate group, the mass of the conjugate group is included in calculating the dose of such oligomeric compound. If the conjugate group also has an acid, the conjugate group is likewise assumed to be fully protonated for the purpose of calculating dose.

VII. Certain Compositions

1. Compound No. 1065645

In certain embodiments, Compound No. 1065645 is characterized as a 5-10-5 MOE gapmer having a sequence (from 5' to 3') of CATCATGATCTTGGTAAGGC (SEQ ID NO: 1949), wherein each of nucleosides 1-5 and 16-20 (from 5' to 3') are 2'-MOE nucleosides and each of nucleosides 6-15 are 2'-β-D-deoxynucleosides, wherein the internucleoside linkages between nucleosides 2 to 3, 3 to 4, 4 to 5, 5 to 6, 16 to 17, and 17 to 18 are phosphodiester internucleoside linkages and the internucleoside linkages between nucleosides 1 to 2, 6 to 7, 7 to 8, 8 to 9, 9 to 10, 10 to 11, 11 to 12, 12 to 13, 13 to 14, 14 to 15, 15 to 16, 18 to 19, and 19 to 20 are phosphorothioate internucleoside linkages, and wherein each cytosine is a 5-methyl cytosine.

In certain embodiments, Compound No. 1065645 is represented by the following chemical notation: $^{m}C_{es}A_{eo}T_{eo}{}^{m}C_{eo}A_{eo}T_{ds}G_{ds}A_{ds}T_{ds}{}^{m}C_{ds}T_{ds}T_{ds}G_{ds}G_{ds}T_{ds}A_{eo}A_{eo}G_{es}G_{es}{}^{m}C_{e}$ (SEQ ID NO: 1949), wherein:

A=an adenine nucleobase, mC=a 5-methyl cytosine nucleobase,

G=a guanine nucleobase,

T=a thymine nucleobase, e=a 2'-MOE sugar moiety, d=a 2'-β-D-deoxyribosyl sugar moiety, s=a phosphorothioate internucleoside linkage, and o=a phosphodiester internucleoside linkage.

In certain embodiments, Compound No. 1065645 is represented by the following chemical structure:
Structure 1. Compound No. 1065645
(SEQ ID NO: 1949)
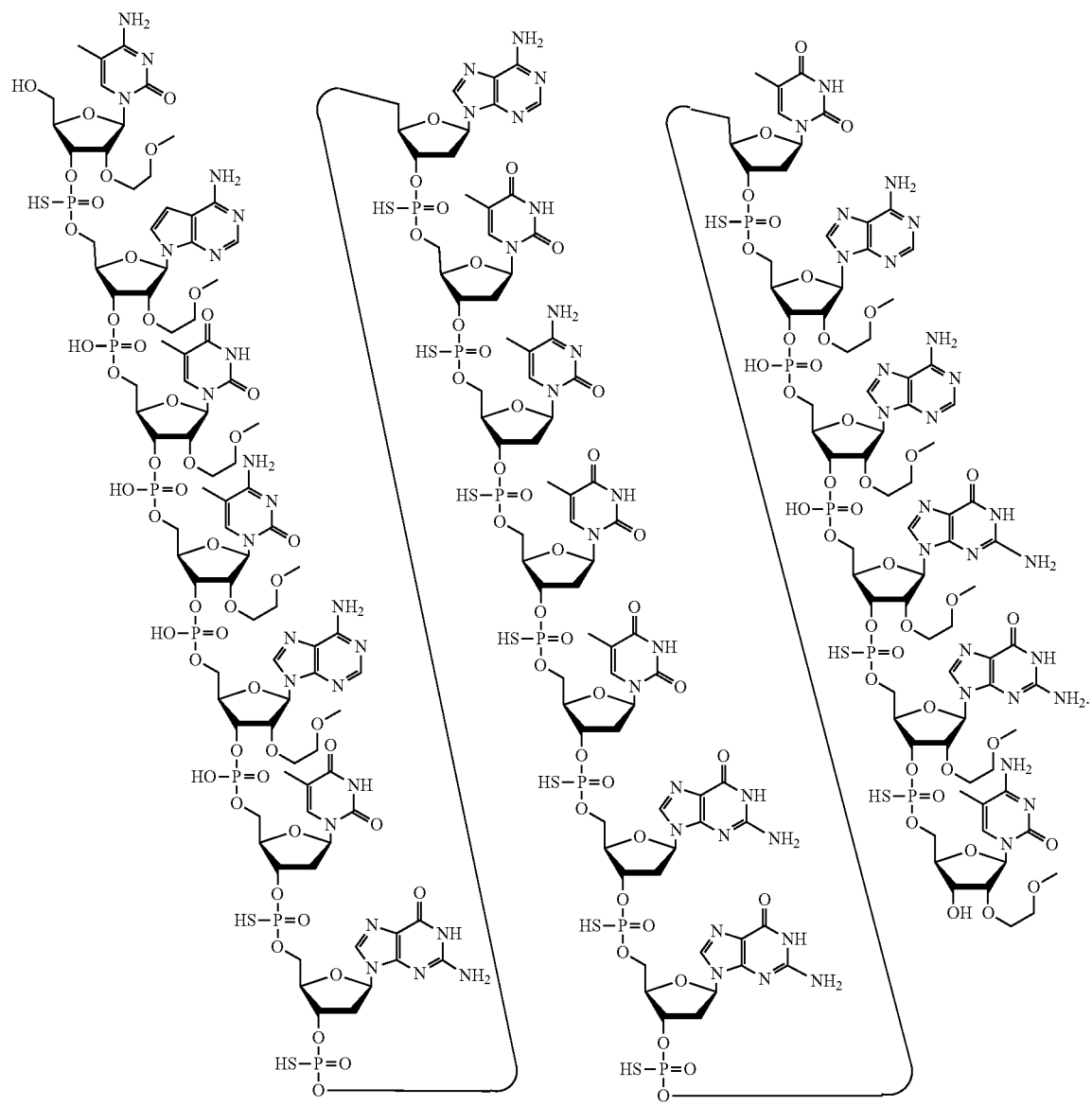

In certain embodiments, the sodium salt of Compound No. 1065645 is represented by the following chemical structure:

Structure 2. The sodium salt of Compound No. 1065645

(SEQ ID NO: 1949)

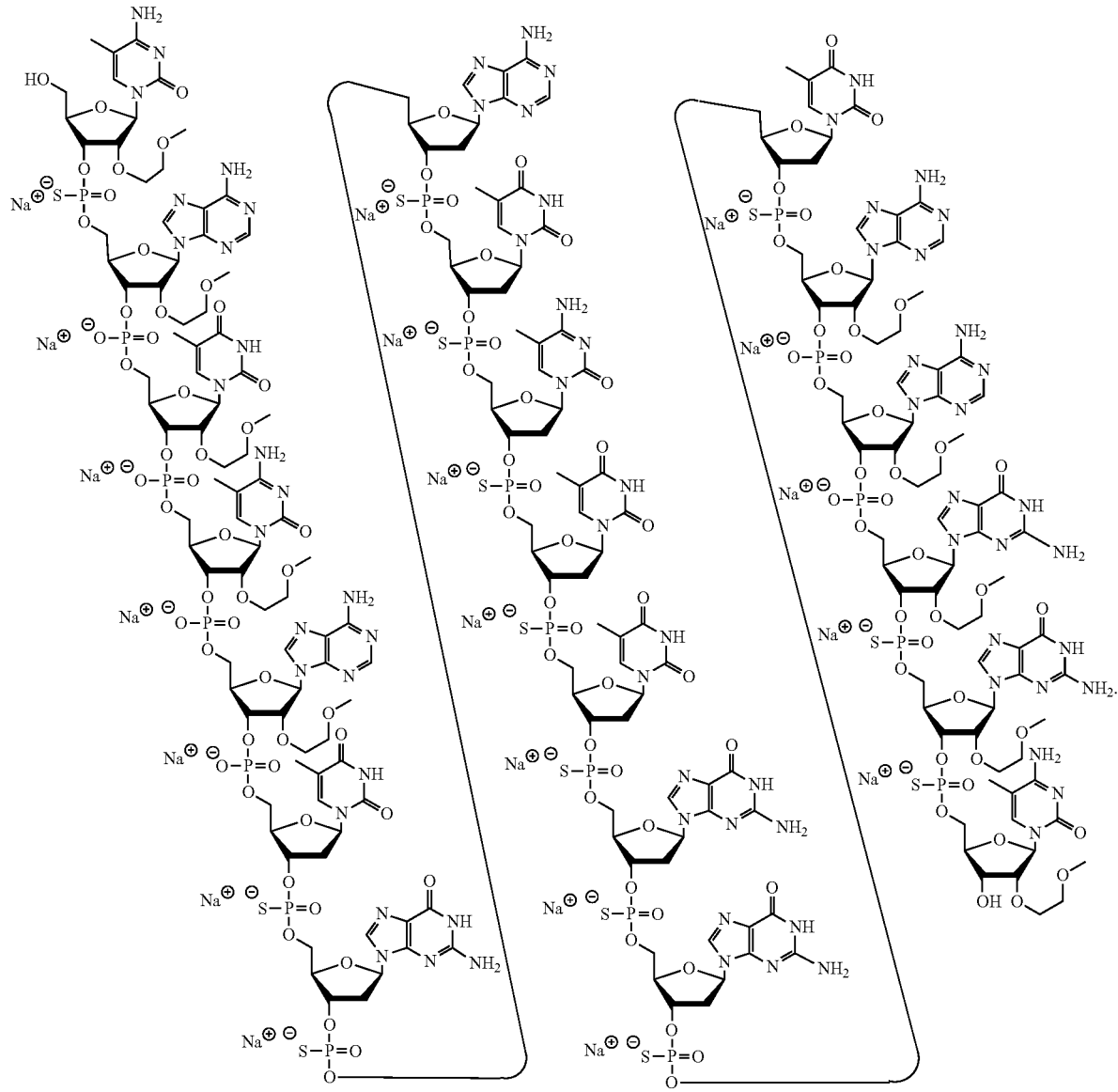

2. Compound No. 1263517

In certain embodiments, Compound No. 1263517 is characterized as a 6-10-4 MOE gapmer having a sequence (from 5' to 3') of TCACCATTTTGACCTTCTTA (SEQ ID NO: 2751), wherein each of nucleosides 1-6 and 17-20 (from 5' to 3') are 2'-MOE nucleosides and each of nucleosides 7-16 are 2'-β-D-deoxynucleosides, wherein the internucleoside linkages between nucleosides 2 to 3, 3 to 4, 4 to 5, 5 to 6, 6 to 7, and 17 to 18 are phosphodiester internucleoside linkages and the internucleoside linkages between nucleosides 1 to 2, 7 to 8, 8 to 9, 9 to 10, 10 to 11, 11 to 12, 12 to 13, 13 to 14, 14 to 15, 15 to 16, 16 to 17, 18 to 19, and 19 to 20 are phosphorothioate internucleoside linkages, and wherein each cytosine is a 5-methyl cytosine.

In certain embodiments, Compound No. 1263517 is represented by the following chemical notation: $T_{es}{}^{m}C_{eo}A_{eo}{}^{m}C_{eo}{}^{m}C_{eo}A_{eo}T_{ds}T_{ds}T_{ds}T_{ds}G_{ds}A_{ds}{}^{m}C_{ds}{}^{m}C_{ds}T_{ds}T_{ds}{}^{m}C_{eo}T_{es}T_{es}A_{e}$ (SEQ ID NO: 2751), wherein:
A=an adenine nucleobase,
mC=a 5-methyl cytosine nucleobase,
G=a guanine nucleobase,
T=a thymine nucleobase,
e=a 2'-MOE sugar moiety,
d=a 2'-β-D-deoxyribosyl sugar moiety,
s=a phosphorothioate internucleoside linkage, and
o=a phosphodiester internucleoside linkage.

In certain embodiments, Compound No. 1263517 is represented by the following chemical structure:

Structure 3. Compound No. 1263517
(SEQ ID NO: 2751)
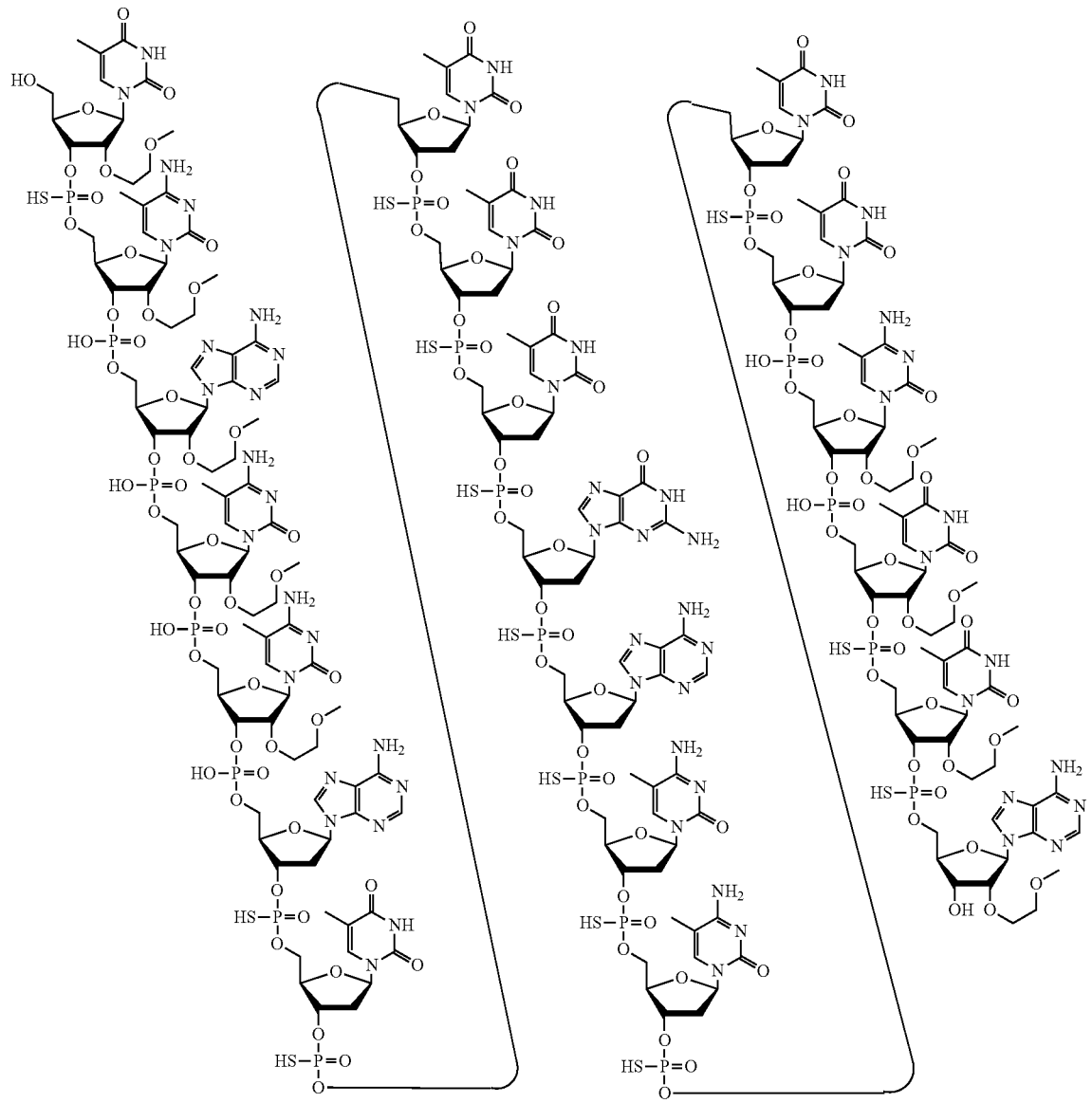

In certain embodiments, the sodium salt of Compound No. 1263517 is represented by the following chemical structure:

Structure 4. The sodium salt of Compound No. 1263517

(SEQ ID NO: 2751)

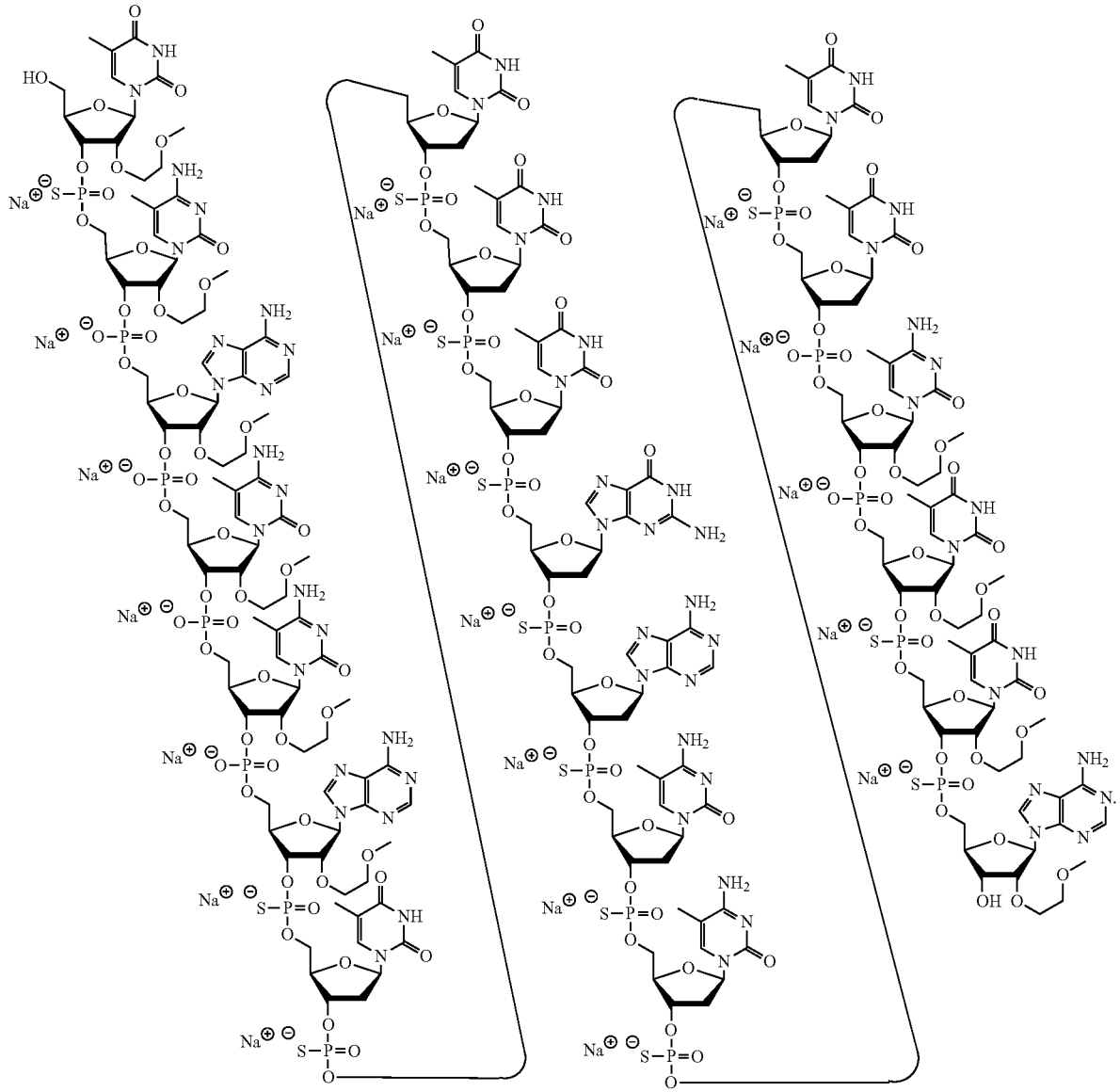

3. Compound No. 1263518

In certain embodiments, Compound No. 1263518 is characterized as a 6-10-4 MOE gapmer having a sequence (from 5' to 3') of TTCACCATTTTGACCTTCTT (SEQ ID NO: 2752), wherein each of nucleosides 1-6 and 17-20 (from 5' to 3') are 2'-MOE nucleosides and each of nucleosides 7-16 are 2'-β-D-deoxynucleosides, wherein the internucleoside linkages between nucleosides 2 to 3, 3 to 4, 4 to 5, 5 to 6, 6 to 7, and 17 to 18 are phosphodiester internucleoside linkages and the internucleoside linkages between nucleosides 1 to 2, 7 to 8, 8 to 9, 9 to 10, 10 to 11, 11 to 12, 12 to 13, 13 to 14, 14 to 15, 15 to 16, 16 to 17, 18 to 19, and 19 to 20 are phosphorothioate internucleoside linkages, and wherein each cytosine is a 5-methyl cytosine.

In certain embodiments, Compound No. 1263518 is represented by the following chemical notation: $T_{es}T_{eo}{}^mC_{eo}A_{eo}{}^mC_{eo}{}^mC_{eo}A_{ds}T_{ds}T_{ds}T_{ds}T_{ds}G_{ds}A_{ds}{}^mC_{ds}{}^mC_{ds}T_{ds}T_{eo}{}^mC_{es}T_{es}T_e$ (SEQ ID NO: 2752), wherein:

A=an adenine nucleobase,
mC=a 5-methyl cytosine nucleobase,
G=a guanine nucleobase,
T=a thymine nucleobase,
e=a 2'-MOE sugar moiety,
d=a 2'-β-D-deoxyribosyl sugar moiety,
s=a phosphorothioate internucleoside linkage, and
o=a phosphodiester internucleoside linkage.

In certain embodiments, Compound No 1263518 is renresented by the following chemical structure:

Structure 5. Compound No. 1263518
(SEQ ID NO: 2752)
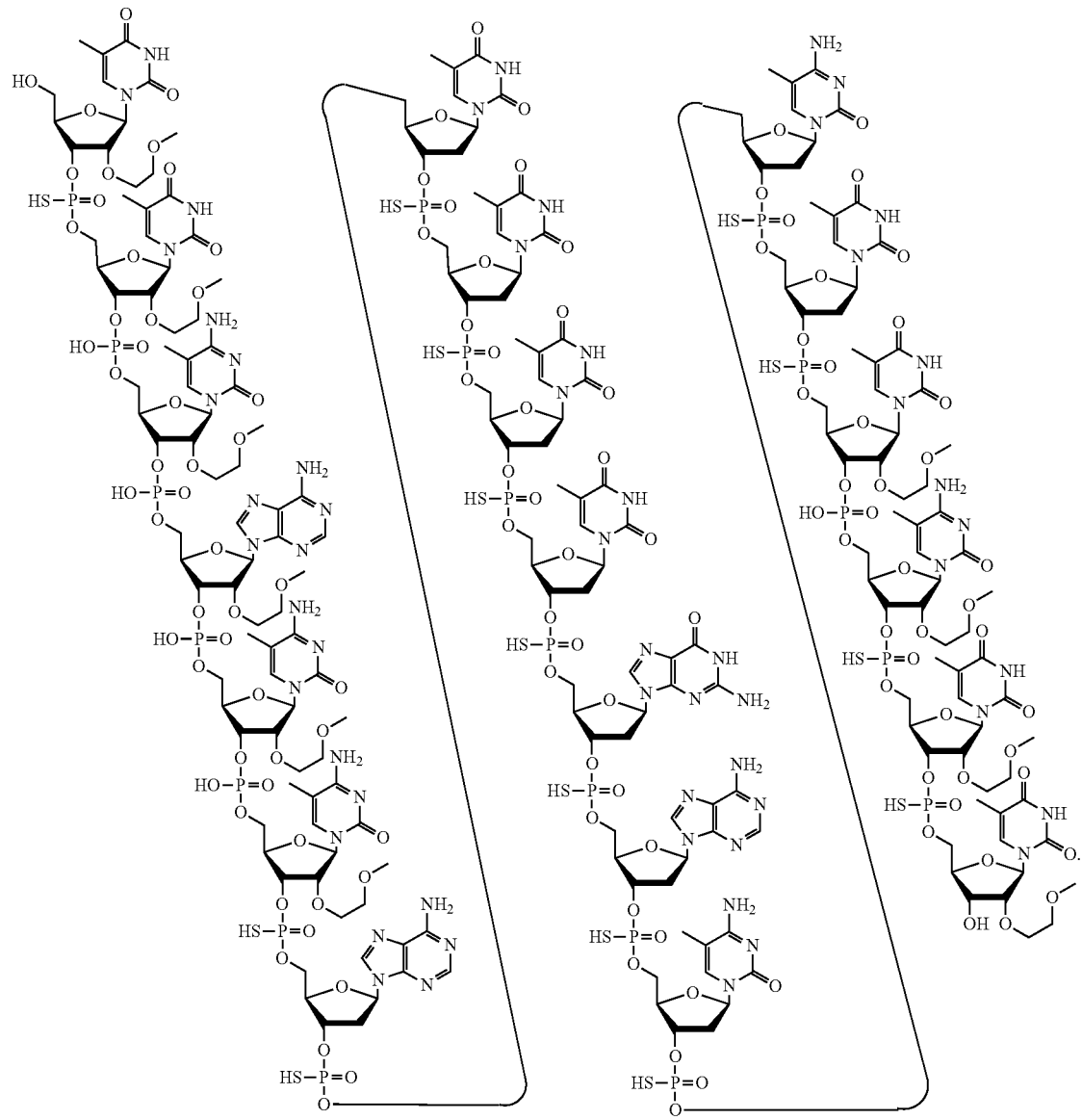

In certain embodiments, the sodium salt of Compound No. 1263518 is represented by the following chemical structure:

Structure 6. The sodium salt of Compound No. 1263518

(SEQ ID NO: 2752)

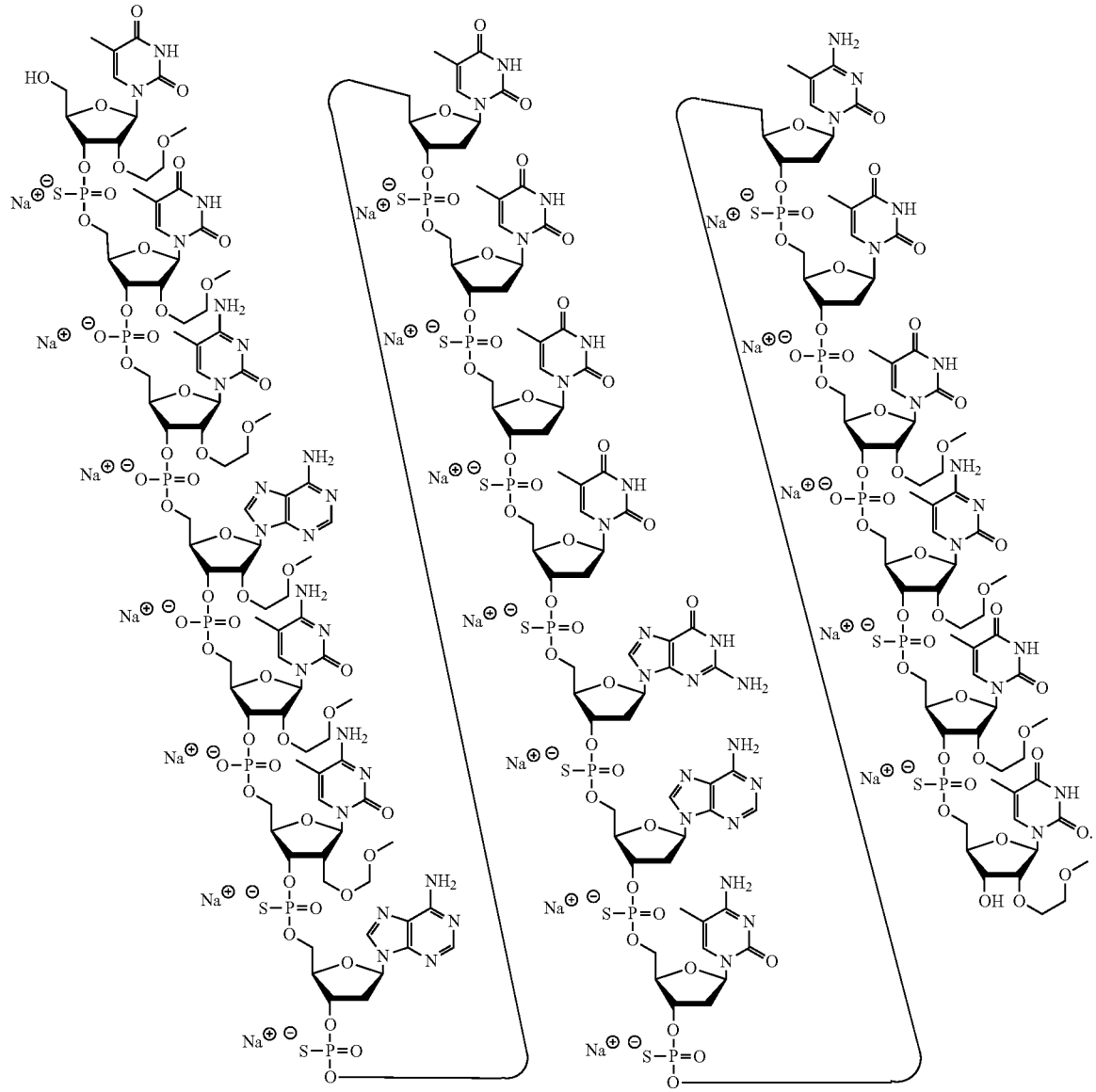

4. Compound No. 1263533

In certain embodiments, Compound No. 1263533 is characterized as a 6-10-4 MOE gapmer having a sequence (from 5' to 3') of GCATACCCAGGGTAGGATTC (SEQ ID NO: 765), wherein each of nucleosides 1-6 and 17-20 (from 5' to 3') are 2'-MOE nucleosides and each of nucleosides 7-16 are 2'-β-D-deoxynucleosides, wherein the internucleoside linkages between nucleosides 2 to 3, 3 to 4, 4 to 5, 5 to 6, 6 to 7, and 17 to 18 are phosphodiester internucleoside linkages and the internucleoside linkages between nucleosides 1 to 2, 7 to 8, 8 to 9, 9 to 10, 10 to 11, 11 to 12, 12 to 13, 13 to 14, 14 to 15, 15 to 16, 16 to 17, 18 to 19, and 19 to 20 are phosphorothioate internucleoside linkages, and wherein each cytosine is a 5-methyl cytosine.

In certain embodiments, Compound No. 1263533 is represented by the following chemical notation: $G_{es}{}^mC_{eo}A_{eo}\text{-}T_{eo}A_{eo}{}^mC_{eo}{}^mC_{ds}{}^mC_{ds}A_{ds}G_{ds}G_{ds}G_{ds}T_{ds}A_{ds}G_{ds}G_{ds}A_{e\text{-}o}T_{es}T_{es}{}^mC_e$ (SEQ ID NO: 765), wherein:

A=an adenine nucleobase,
mC=a 5-methyl cytosine nucleobase,
G=a guanine nucleobase,
T=a thymine nucleobase,
e=a 2'-MOE sugar moiety,
d=a 2'-β-D-deoxyribosyl sugar moiety,
s=a phosphorothioate internucleoside linkage, and
o=a phosphodiester internucleoside linkage.

In certain embodiments, Compound No. 1263533 is represented by the following chemical structure:

Structure 7. Compound No. 1263533
(SEQ ID NO: 765)
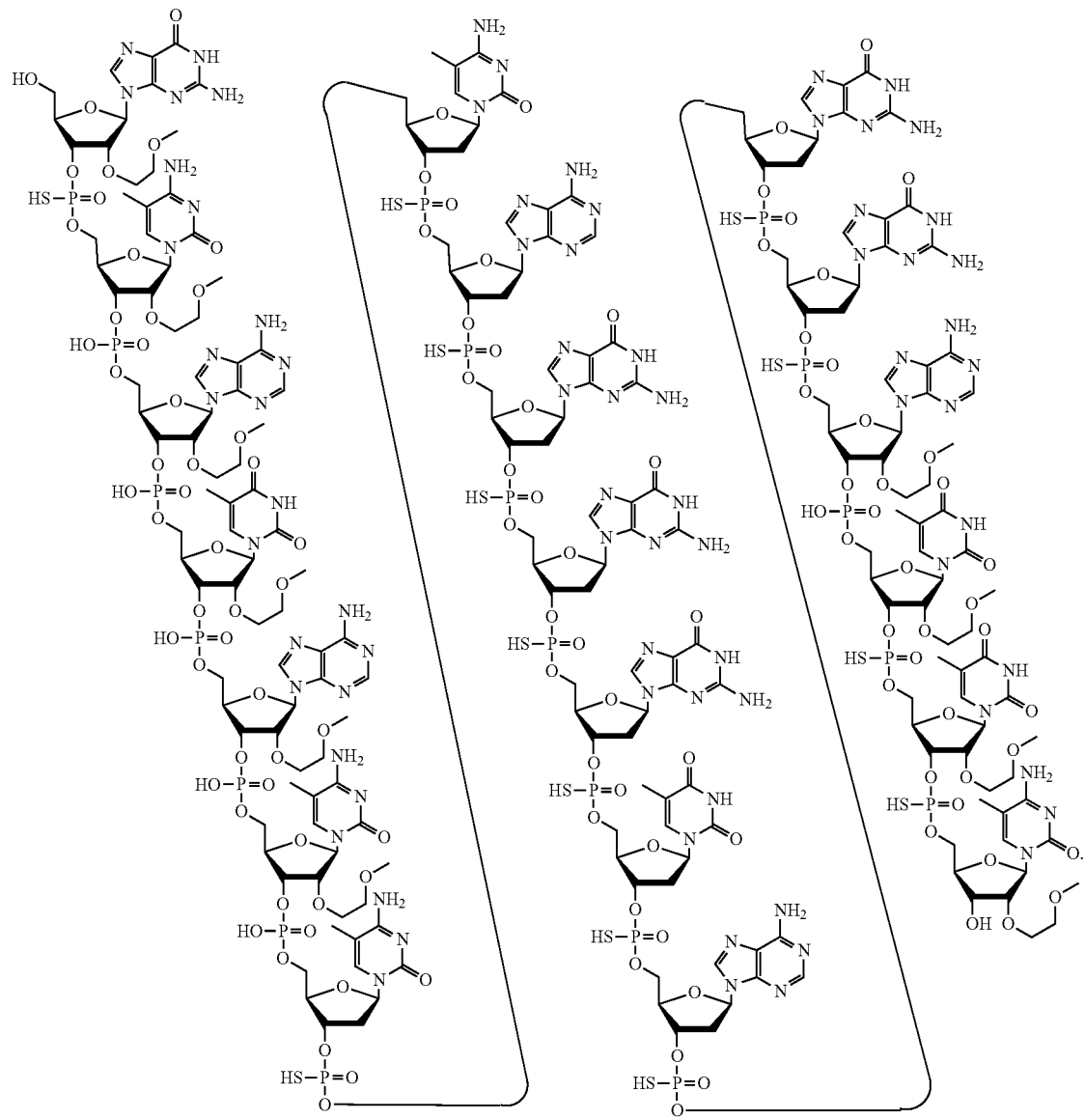

In certain embodiments, the sodium salt of Compound No. 1263533 is represented by the chemical structure:

Structure 8. The sodium salt of Compound No. 1263533

(SEQ ID NO: 765)

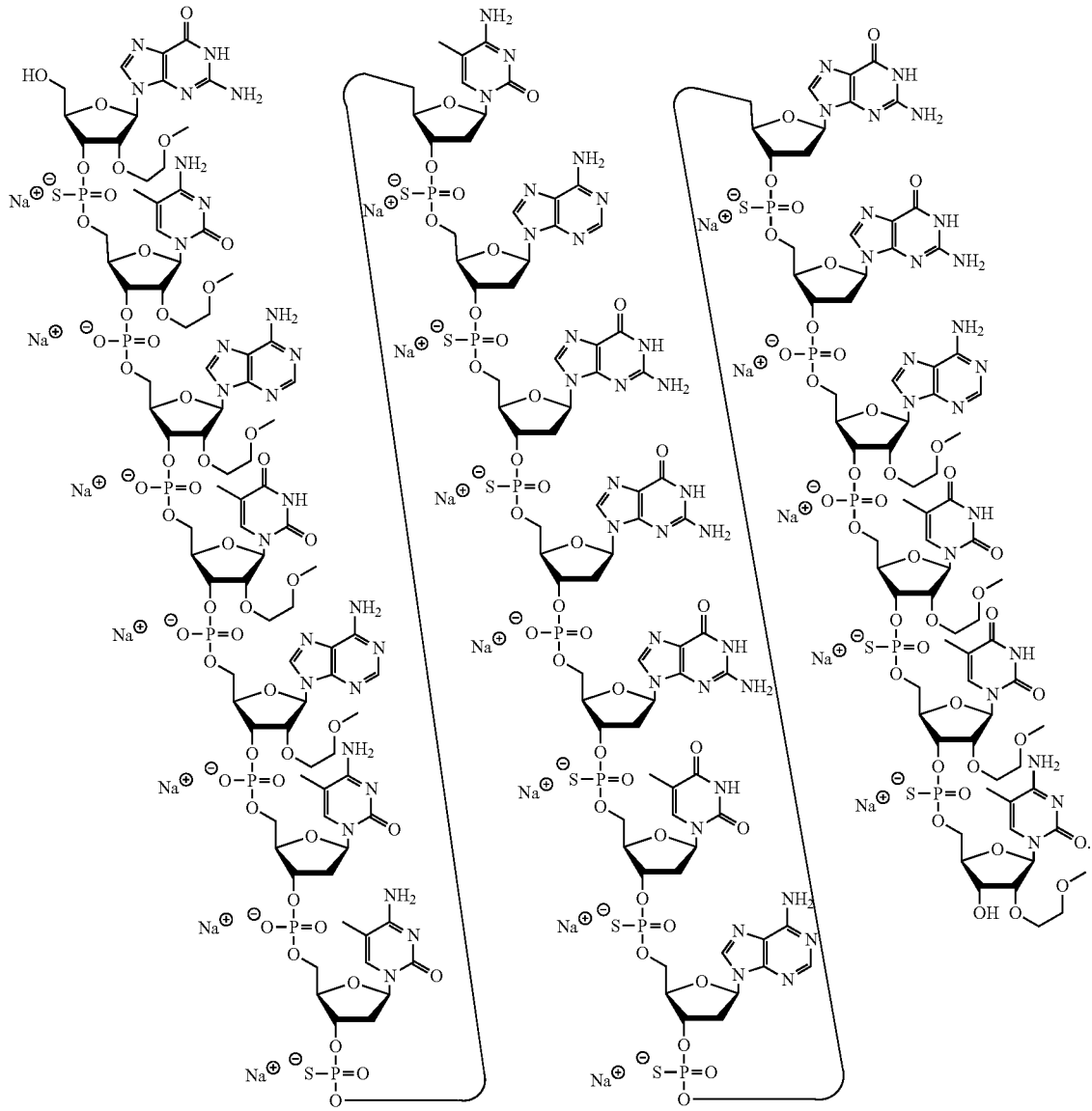

5. Compound No. 1273039

In certain embodiments, Compound No. 1273039 is characterized as a 4-8-6 MOE gapmer having a sequence (from 5' to 3') of ACGCAATGTATCAGGCAA (SEQ ID NO: 2866), wherein each of nucleosides 1-4 and 13-18 (from 5' to 3') are 2'-MOE nucleosides and each of nucleosides 5-12 are 2'-β-D-deoxynucleosides, wherein the internucleoside linkages between nucleosides 2 to 3, 3 to 4, 13 to 14, 14 to 15, and 15 to 16 are phosphodiester internucleoside linkages and the internucleoside linkages between nucleosides 1 to 2, 4 to 5, 5 to 6, 6 to 7, 7 to 8, 8 to 9, 9 to 10, 10 to 11, 11 to 12, 12 to 13, 16 to 17, and 17 to 18 are phosphorothioate internucleoside linkages, and wherein each cytosine is a 5-methyl cytosine.

In certain embodiments, Compound No. 1273039 is represented by the following chemical notation: $A_{es}{}^{m}C_{eo}G_{eo}{}^{m}C_{es}A_{ds}A_{ds}T_{ds}G_{ds}T_{ds}A_{ds}T_{ds}{}^{m}C_{ds}A_{eo}G_{eo}G_{eo}{}^{m}C_{es}A_{es}A_{e}$ (SEQ ID NO: 2866), wherein:

A=an adenine nucleobase,
mC=a 5-methyl cytosine nucleobase,
G=a guanine nucleobase,
T=a thymine nucleobase,
e=a 2'-MOE sugar moiety,
d=a 2'-β-D-deoxyribosyl sugar moiety,
s=a phosphorothioate internucleoside linkage, and
o=a phosphodiester internucleoside linkage.

In certain embodiments, Compound No. 1273039 is represented by the following chemical structure:

Structure 9. Compound No. 1273039
(SEQ ID NO: 2866)
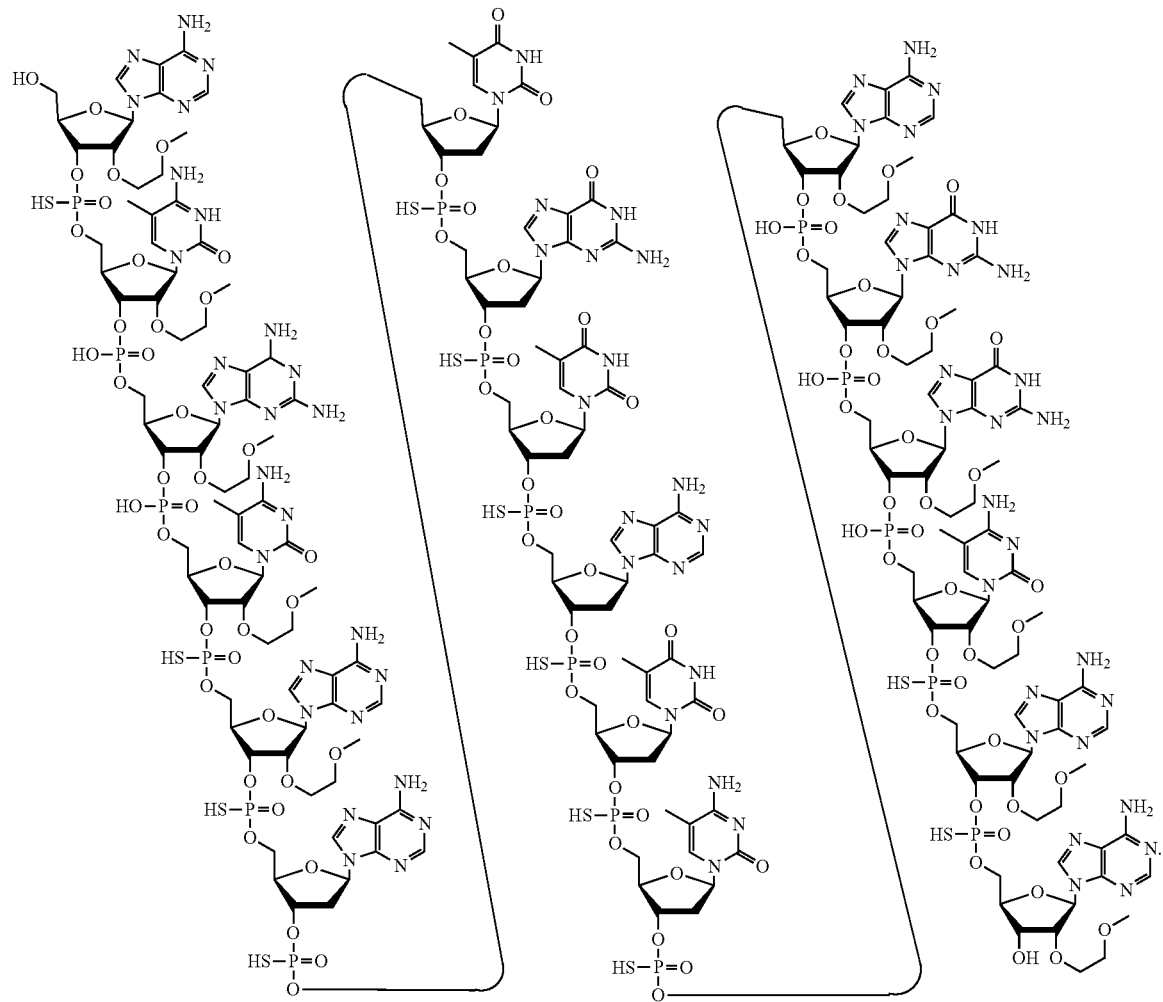

In certain embodiments, the sodium salt of Compound No. 1273039 is represented by the following chemical structure:

Structure 10. The sodium salt of Compound No. 1273039

(SEQ ID NO: 2866)

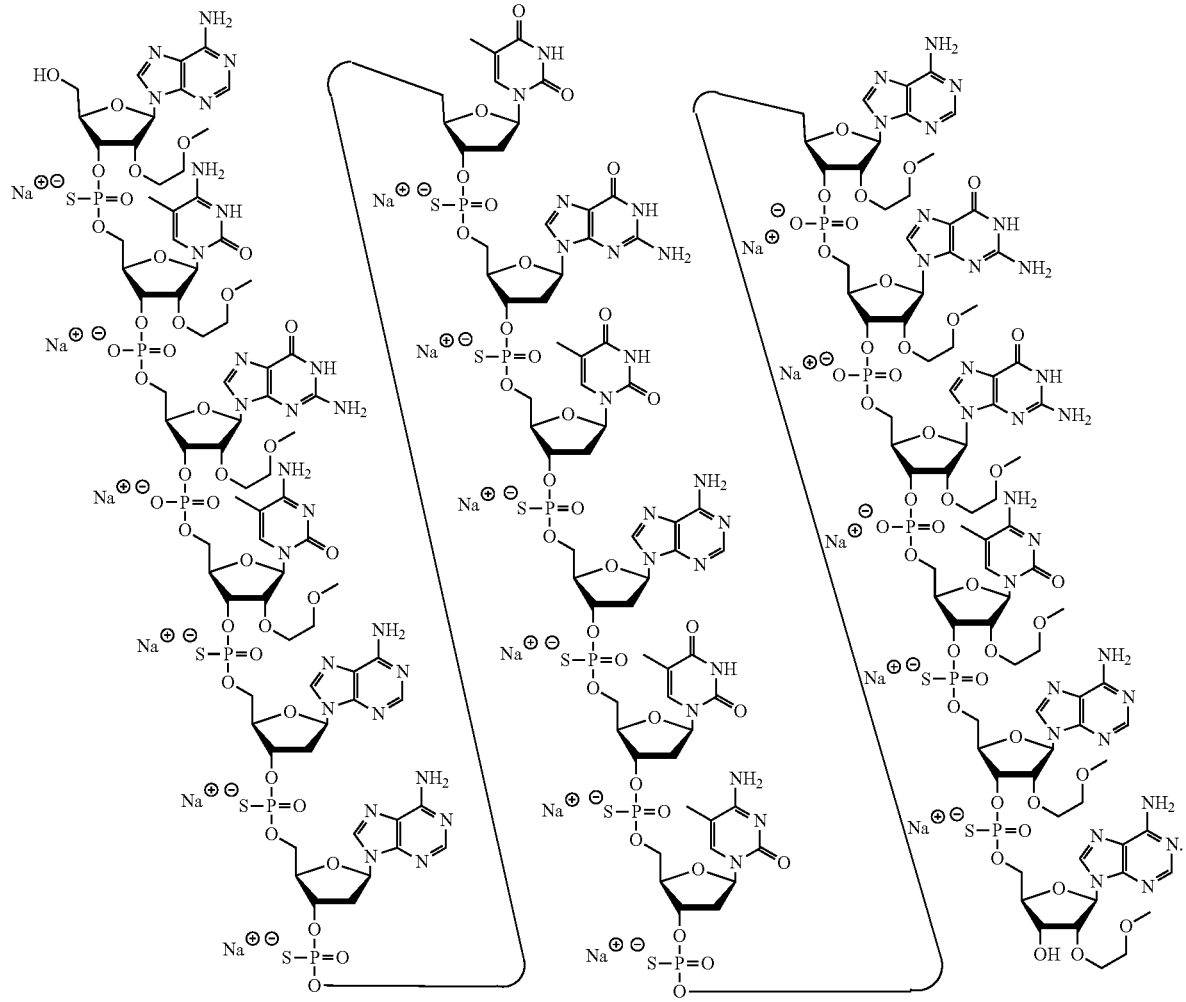

6. Compound No. 1273062

In certain embodiments, Compound No. 1273062 is characterized as a 5-10-5 MOE gapmer having a sequence (from 5' to 3') of ACCATTTTGACCTTCTTAGC (SEQ ID NO: 2873), wherein each of nucleosides 1-5 and 16-20 (from 5' to 3') are 2'-MOE nucleosides and each of nucleosides 6-15 are 2'-β-D-deoxynucleosides, wherein the internucleoside linkages between nucleosides 2 to 3, 3 to 4, 4 to 5, 5 to 6, 16 to 17, and 17 to 18 are phosphodiester internucleoside linkages and the internucleoside linkages between nucleosides 1 to 2, 6 to 7, 7 to 8, 8 to 9, 9 to 10, 10 to 11, 11 to 12, 12 to 13, 13 to 14, 14 to 15, 15 to 16, 18 to 19, and 19 to 20 are phosphorothioate internucleoside linkages, and wherein each cytosine is a 5-methyl cytosine.

In certain embodiments, Compound No. 1273062 is represented by the following chemical notation: $A_{es}{}^mC_{eo}{}^m C_{eo} A_{eo} T_{eo} T_{ds} T_{ds} T_{ds} G_{ds} A_{ds}{}^mC_{ds}{}^mC_{ds} T_{ds} T_{ds}{}^mC_{ds} T_{eo} T_{eo} A_{es} G_{es}{}^mC_e$ (SEQ ID NO: 2873), wherein:

A=an adenine nucleobase,
mC=a 5-methyl cytosine nucleobase,
G=a guanine nucleobase,
T=a thymine nucleobase,
e=a 2'-MOE sugar moiety,
d=a 2'-β-D-deoxyribosyl sugar moiety,
s=a phosphorothioate internucleoside linkage, and
o=a phosphodiester internucleoside linkage.

In certain embodiments, Compound No. 1273062 is represented by the following chemical structure:
Structure 11. Compound No. 1273062
(SEQ ID NO: 2873)
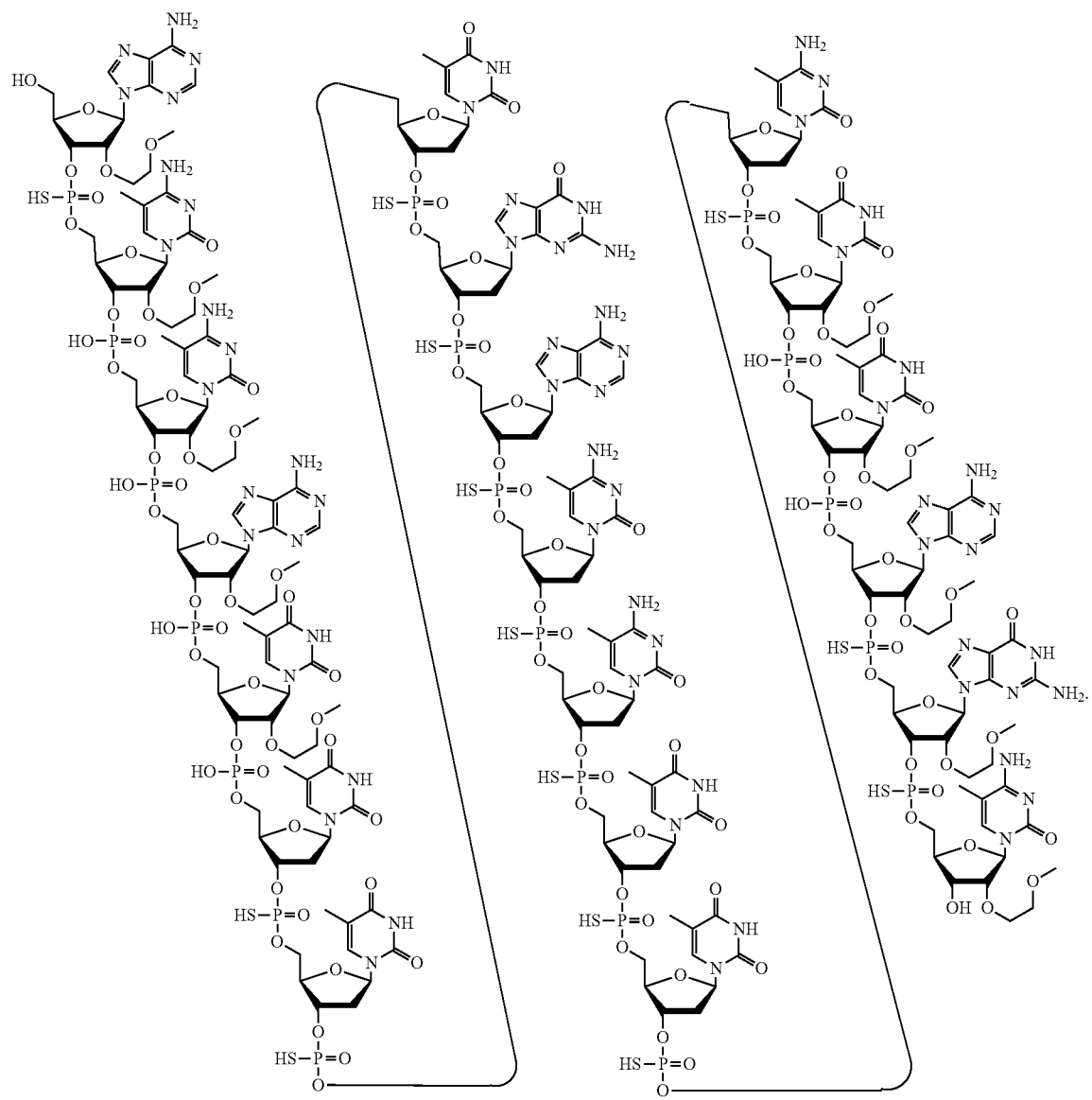

In certain embodiments, the sodium salt of Compound No. 1273062 is represented by the following chemical structure:

Structure 12. The sodium salt of Compound No. 1273062

(SEQ ID NO: 2873)

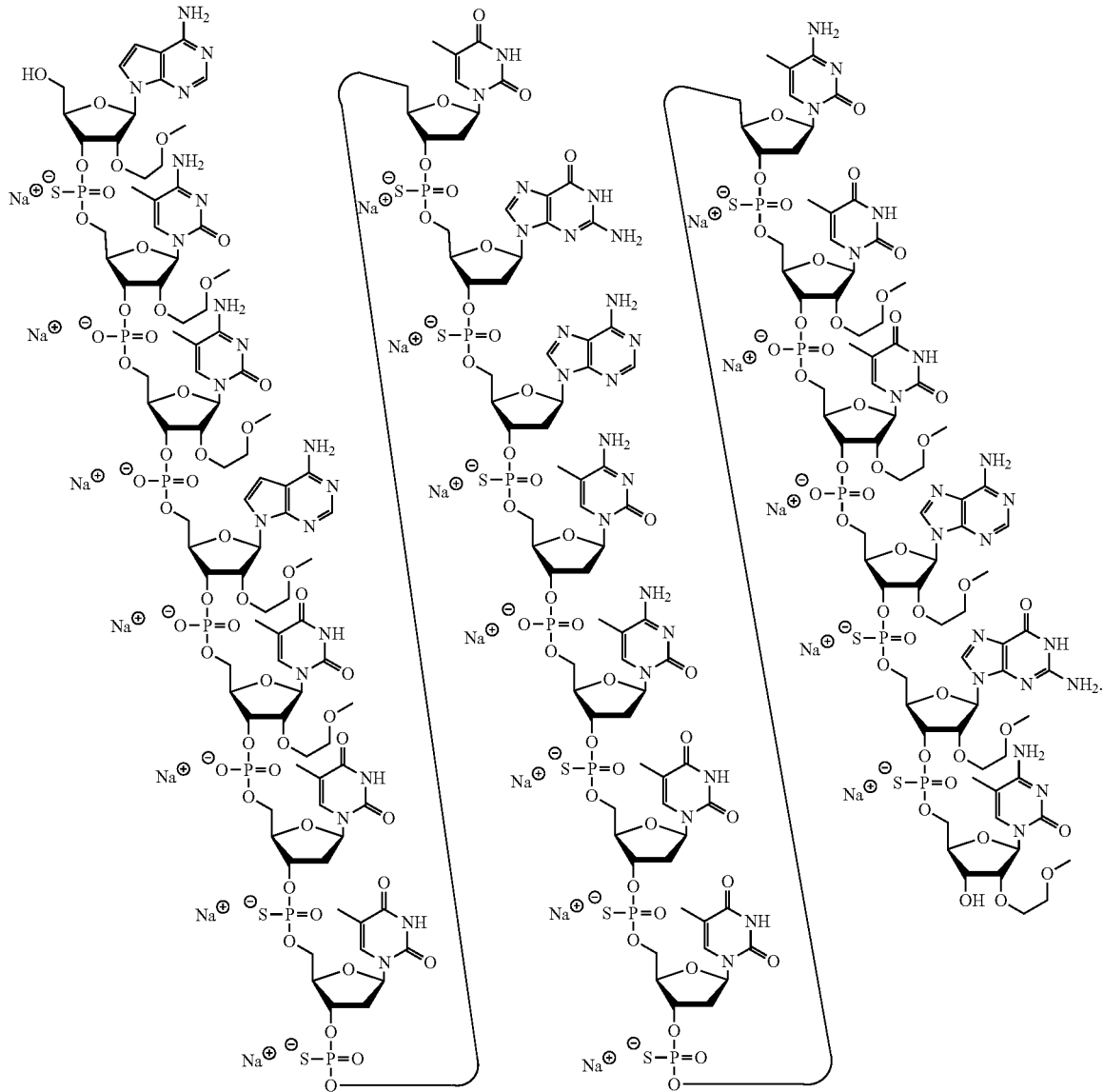

VIII. Certain Comparator Compounds

In certain embodiments, Compound No. 1219022, a surrogate of which (Compound #586_9) is provided in WO2017/081223 (incorporated herein by reference), was used as a comparator compound. Compound No. 1219022 is a mixed LNA/DNA oligonucleotide having a sugar motif of (from 5' to 3') llddldlddddddddllll, wherein each "l" represents an LNA sugar moiety and each "d" represents a 2'-β-D-deoxyribosyl sugar moiety; having a sequence of (from 5' to 3') AAATTATTTATACACCATCA (SEQ ID NO: 2905), wherein each "C" is a 5-methyl cytosine; and wherein each internucleoside linkage is a phosphorothioate internucleoside linkage. Compound #586_9 has cytosines at positions 13, 15, and 16 whereas Compound No. 1219022 5-methyl cytosines at those positions. According to Wan and Seth, "Nntroduction of the 5-methyl group on cytosine reduces the immunostimulatory profile of certain DNA oligonucleotides and also enhances nuclease stability" (J. Med. Chem. 2016, 59, 9645-9667).

In certain embodiments, Compound No. 1219023, a surrogate of which (Compound #572_7) is provided in WO2017/081223 (incorporated herein by reference), was used as a comparator compound. Compound No. 1219023 is a mixed LNA/DNA oligonucleotide having a sugar motif of (from 5' to 3') llddldlddddddddllll, wherein each "l" represents an LNA sugar moiety and each "d" represents a 2'-β-D-deoxyribosyl sugar moiety; having a sequence of (from 5' to 3') TTTATCAATATCTTCTCA (SEQ ID NO: 2906), wherein each "C" is a 5-methyl cytosine; and wherein each internucleoside linkage is a phosphorothioate internucleoside linkage. Compound #572_7 has cytosines at positions 12 and 15 whereas Compound No. 1219023 has 5-methyl cytosines at those positions.

In certain embodiments, Compound No. 1219024, a surrogate of which (Compound #591_1) is provided in WO2017/081223 (incorporated herein by reference), was used as a comparator compound. Compound No. 1219024 is a mixed LNA/DNA oligonucleotide having a sugar motif of (from 5' to 3') ldldlddddddddddddll, wherein each "l" represents an LNA sugar moiety and each "d" represents a 2'-ß-D-deoxyribosyl sugar moiety; having a sequence of (from 5' to 3') GCACATTCTTTCTATACCT (SEQ ID NO: 2907), wherein each "C" is a 5-methyl cytosine; and wherein each internucleoside linkage is a phosphorothioate internucleoside linkage. Compound #591_1 has cytosines at positions 2, 4, 8, 12 and 17 whereas Compound No. 1219024 has 5-methyl cytosines at those positions.

In certain embodiments, Compound No. 1219025, a surrogate of which (Compound #169_52) is provided in WO2017/081223 (incorporated herein by reference), was used as a comparator compound. Compound No. 1219025 is a mixed LNA/DNA oligonucleotide having a sugar motif of (from 5' to 3') lldllddddddddddll, wherein each "l" represents an LNA sugar moiety and each "d" represents a 2'-ß-D-deoxyribosyl sugar moiety; having a sequence of (from 5' to 3') TTATAGCCATTCTATCT (SEQ ID NO: 2908), wherein each "C" is a 5-methyl cytosine; and wherein each internucleoside linkage is a phosphorothioate internucleoside linkage. Compound #169_52 has cytosines at positions 7, 8, and 12 whereas Compound No. 1219025 has 5-methyl cytosines at those positions.

In certain embodiments, Compound No. 1219026, a surrogate of which (Compound #624_5) is provided in WO2017/081223 (incorporated herein by reference), was used as a comparator compound. Compound No. 1219026 is a mixed LNA/DNA oligonucleotide having a sugar motif of (from 5' to 3') ldlllddddddddllll, wherein each "l" represents an LNA sugar moiety and each "d" represents a 2'-ß-D-deoxyribosyl sugar moiety; having a sequence of (from 5' to 3') CTCAAAGATCATTCTCA (SEQ ID NO: 2909), wherein each "C" is a 5-methyl cytosine; and wherein each internucleoside linkage is a phosphorothioate internucleoside linkage. Compound # 624_5 has a cytosine at position 10 whereas Compound No. 1219026 has a 5-methyl cytosine at that position.

In certain embodiments, Compound No. 1219027, a surrogate of which (Compound #626_8) is provided in WO2017/081223 (incorporated herein by reference), was used as a comparator compound. Compound No. 1219027 is a mixed LNA/DNA oligonucleotide having a sugar motif of (from 5' to 3') ldldldlddddddddldll, wherein each "l" represents an LNA sugar moiety and each "d" represents a 2'-ß-D-deoxyribosyl sugar moiety; having a sequence of (from 5' to 3') TTACACTTAATTATACTTCC (SEQ ID NO: 2910), wherein each "C" is a 5-methyl cytosine; and wherein each internucleoside linkage is a phosphorothioate internucleoside linkage. Compound #626_8 has cytosines at positions 4, 6, and 16 whereas Compound No. 1219027 has 5-methyl cytosines at those positions.

In certain embodiments, Compound No. 1219028, a surrogate of which (Compound #639_5) is provided in WO2017/081223 (incorporated herein by reference), was used as a comparator compound. Compound No. 1219028 is a mixed LNA/DNA oligonucleotide having a sugar motif of (from 5' to 3') lddddddddddddlldlll, wherein each "l" represents an LNA sugar moiety and each "d" represents a 2'-ß-D-deoxyribosyl sugar moiety; having a sequence of (from 5' to 3') GTTTCCATCTACTATTAA (SEQ ID NO: 2911), wherein each "C" is a 5-methyl cytosine; and wherein each internucleoside linkage is a phosphorothioate internucleoside linkage. Compound #639_5 has cytosines at positions 5, 6, 9 and 12 whereas Compound No. 1219028 has 5-methyl cytosines at those positions.

In certain embodiments, Compound No. 1219029, a surrogate of which (Compound #642_12) is provided in WO2017/081223 (incorporated herein by reference), was used as a comparator compound. Compound No. 1219029 is a mixed LNA/DNA oligonucleotide having a sugar motif of (from 5' to 3') lldldlddddddddddll, wherein each "l" represents an LNA sugar moiety and each "d" represents a 2'-ß-D-deoxyribosyl sugar moiety; having a sequence of (from 5' to 3') CTGTATACACCATCCCA (SEQ ID NO: 2912), wherein each "C" is a 5-methyl cytosine; and wherein each internucleoside linkage is a phosphorothioate internucleoside linkage. Compound #642_12 has cytosines at positions 8, 10, 11, 14 and 15 whereas Compound No. 1219029 has 5-methyl cytosines at those positions.

In certain embodiments, Compound No. 1219030, a surrogate of which (Compound #304_6) is provided in WO2017/081223 (incorporated herein by reference), was used as a comparator compound. Compound No. 1219030 is a mixed LNA/DNA oligonucleotide having a sugar motif of (from 5' to 3') lddllddddddddlllll, wherein each "l" represents an LNA sugar moiety and each "d" represents a 2'-ß-D-deoxyribosyl sugar moiety, having a sequence of (from 5' to 3') AGTTCTACTATACTTTC (SEQ ID NO: 2913), wherein each "C" is a 5-methyl cytosine; and wherein each internucleoside linkage is a phosphorothioate internucleoside linkage. Compound #304_6 has cytosines at positions 8 and 13 whereas Compound No. 1219030 has 5-methyl cytosines at those positions.

In certain embodiments, Compound No. 1219031, a surrogate of which (Compound #573_8) is provided in WO2017/081223 (incorporated herein by reference), was used as a comparator compound. Compound No. 1219031 is a mixed LNA/DNA oligonucleotide having a sugar motif of (from 5' to 3') llddldlddddddddddddll, wherein each "l" represents an LNA sugar moiety and each "d" represents a 2'-ß-D-deoxyribosyl sugar moiety; having a sequence of (from 5' to 3') TATACCTTTCTTTAACCCTT (SEQ ID NO: 2914), wherein each "C" is a 5-methyl cytosine; and wherein each internucleoside linkage is a phosphorothioate internucleoside linkage. Compound #573_8 has cytosines at positions 6, 10, 16, 17, and 18 whereas Compound No. 1219031 has cytosines at those positions.

Compound Nos. 1219022-1219031 (relating to Compound Nos. #586_9, #572_7, #591_1, #169_52, #624_5, #626_8, #639_5 #642_12, #304_6, #573_8, respectively) were selected as comparator compounds from Example 7 of WO2017/081223, which provides a subset of active compounds "selected for potency and efficacy testing."

In certain embodiments, compounds described herein are superior relative to compounds described in WO2017/081223 because they demonstrate one or more improved properties, such as in vivo tolerability.

For example, as described herein, certain compounds Compound No. 1263517, Compound No. 1263518, Compound No. 1263533, Compound No. 1273039, and Compound No. 1273062 achieved 3-hour FOB scores in mice of 1.0 (Table 88), 0.0 (Table 88), 1.0 (Table 88), 1.0 (Table 96), and 0.0 (Table 96), respectively, whereas each of comparator compounds Compound No. 1219022, Compound No. 1219024, Compound No. 1219025, Compound No. 1219028, Compound No. 1219029, Compound No.

1219030, and Compound No. 1219031 achieved 3-hour FOB scores in mice of 7.0, 5.3, 4.0, 6.0, 6.3, 5.0, and 5.3 (Table 119), respectively. Therefore, certain compounds described herein are more tolerable than comparator compounds Compound No. 1219022, Compound No. 1219024, Compound No. 1219025, Compound No. 1219028, Compound No. 1219029, Compound No. 1219030, and Compound No. 1219031 in this assay.

For example, as described herein, certain compounds Compound No. 1065645, Compound No. 1263517, Compound No. 1263518, Compound No. 1263533, Compound No. 1273039, and Compound No. 1273062 each achieved 2-week FOB scores in mice of 0.0 (Example 12, Table 112), whereas Compound No. 1219023, Compound No. 1219024, Compound No. 1219025, Compound No. 1219026, Compound No. 1219028, Compound No. 1219029, Compound No. 1219030, and Compound No. 1219031 achieved 2-week delayed FOB scores in mice of 3.5, 6.5, 6.0, 6.0, 6.0, 6.0, 6.0, 5.0, and 6.0, respectively (Table 119). Therefore, certain compounds described herein are more tolerable than comparator compounds Compound No. 1219023 and Compound No. 1219026 in this assay.

For example, as described herein, certain compounds Compound No. 1065645, Compound No. 1263517, Compound No. 1263518, Compound No. 1263533, Compound No. 1273039, and Compound No. 1273062 do not cause a significant difference in body weight as compared to PBS-treated rats in an 8-week study, whereas treatment with Compound No. 1219027 leads to a greater than 10% weight loss compared to PBS-treated rats (p-value <0.05, Table 120). Therefore, certain compounds described herein are more tolerable than comparator Compound No. 1219027 in this assay.

IX. Certain Hotspot Regions

In certain embodiments, nucleobases in the ranges specified below comprise a hotspot region of UBE3A-ATS. In certain embodiments, modified oligonucleotides that are complementary to a hotspot region of UBE3A-ATS achieve an average of more than 50% reduction of UBE3A-ATS RNA in vitro in the standard cell assay.

1. Nucleobases 461,413-461,487 of SEQ ID NO: 1

In certain embodiments, nucleobases 461,413-461,487 of SEQ ID NO: 1 comprise a hotspot region. In certain embodiments, modified oligonucleotides are complementary to a portion of nucleobases 461,413-461,487 of SEQ ID NO: 1. In certain embodiments, modified oligonucleotides are 20 nucleobases in length. In certain embodiments, modified oligonucleotides are 18 nucleobases in length. In certain embodiments, modified oligonucleotides are gapmers. In certain embodiments, the gapmers are MOE gapmers. In certain embodiments, the internucleoside linkages of the modified oligonucleotides are phosphorothioate internucleoside linkages and phosphodiester internucleoside linkages. In certain embodiments, the phosphodiester ("o") and phosphorothioate ("s") internucleoside linkages are arranged in order from 5' to 3': soooosssssssssooss, soooooossssssssss-soss, soooosssssssssoss, sooosssssssssooss, sooossssssssss-soooss, or soosssssssssoooss.

The nucleobase sequences of SEQ ID Nos: 1053, 1329, 1501, 1576, 1873, 1949, 2025, 2096, 2245, 2512,2591,2680-2682, and 2844 are complementary to a portion of nucleobases 461,413-461,487 of SEQ ID NO: 1.

The nucleobase sequenc of Compound Nos: 749901-749904, 1065641-1065646, 1165562-1165563, 1165857-1165858, and 1273001 are complementary to a portion of nucleobases 461,413-461,487 of SEQ ID NO: 1.

In certain embodiments, modified oligonucleotides complementary to a portion of nucleobases 461,413-461, 487 of SEQ ID NO: 1 achieve at least 36% reduction of UBE3A-ATS RNA in vitro in the standard cell assay. In certain embodiments, modified oligonucleotides complementary to a portion of nucleobases 461,413-461,487 of SEQ ID NO: 1 achieve an average of 60% reduction of UBE3A-ATS RNA in vitro in the standard cell assay.

2. Nucleobases 468,968-469,013 of SEQ ID NO: 1

In certain embodiments, nucleobases 468,968-469,013 of SEQ ID NO: 1 comprise a hotspot region. In certain embodiments, modified oligonucleotides are complementary to a portion of nucleobases 468,968-469,013 of SEQ ID NO: 1. In certain embodiments, modified oligonucleotides are 20 nucleobases in length. In certain embodiments, modified oligonucleotides are 18 nucleobases in length. In certain embodiments, modified oligonucleotides are gapmers.

In certain embodiments, the gapmers are MOE gapmers. In certain embodiments, the internucleoside linkages of the modified oligonucleotides are phosphorothioate internucleoside linkages and phosphodiester internucleoside linkages. In certain embodiments, the phosphodiester ("o") and phosphorothioate ("s") internucleoside linkages are arranged in order from 5' to 3': soooosssssssssooss, soooooossssssssss-soss, soooosssssssssoss, sooosssssssssooss, sooossssssssss-soooss, or soosssssssssoooss.

The nucleobase sequences of SEQ ID Nos: 376, 377, 2751-2756, 2773-2776, 2872, 2873, 2876-2878 are complementary to a portion of nucleobases 468,968-469,013 of SEQ ID NO: 1.

The nucleobase sequence of Compound Nos: 750031-750032, 1263408-1263411, 1263426, 1263441, 1263460-1263465, 1263486-1263492, 1263517-1263523, 1273061, 1273062, and 1273065-1273067 are complementary to a portion of nucleobases 468,968-469,013 of SEQ ID NO: 1.

In certain embodiments, modified oligonucleotides complementary to a portion of nucleobases 468,968-469, 013 of SEQ ID NO: 1 achieve at least 75% reduction of UBE3A-ATS RNA in vitro in the standard cell assay. In certain embodiments, modified oligonucleotides complementary to a portion of nucleobases 468,968-469,013 of SEQ ID NO: 1 achieve an average of 78% reduction of UBE3A-ATS RNA in vitro in the standard cell assay. In certain embodiments, modified oligonculeotides complementary to a portion of nucleobases 468,968-469,013 of SEQ ID NO: 1 achieve an average of 410% upregulation of UBE3A-ATS RNA in vitro at 6.7 μM in cell culture.

3. Nucleobases 483,965-484,003 of SEQ ID NO: 1

In certain embodiments, nucleobases 483,965-484,003 of SEQ ID NO: 1 comprise a hotspot region. In certain embodiments, modified oligonucleotides are complementary to a portion of 483,965-484,003 of SEQ ID NO: 1. In certain embodiments, modified oligonucleotides are 20 nucleobases in length. In certain embodiments, modified oligonucleotides are 18 nucleobases in length. In certain embodiments, modified oligonucleotides are gapmers. In certain embodiments, the gapmers are MOE gapmers. In certain embodiments, the internucleoside linkages of the modified oligonucleotides are phosphorothioate internucleoside linkages and phosphodiester internucleoside linkages. In certain embodiments, the phosphodiester ("o") and phosphorothioate ("s") internucleoside linkages are arranged in order from 5' to 3': soooosssssssssooss, soooooossssssssssoss, sooosssssssssoss, sooosssssssssooss, sooosssssssssoooss, or soosssssssssoooss.

The nucleobase sequences of SEQ ID Nos: 172, 764-770, 995, 1445, 1668, 1743, 2255, 2595, 2762-2767 are complementary to a portion of nucleobases 483,965-484,003 of SEQ ID NO: 1.

The nucleobase sequence of Compound Nos: 617557, 699781, 750138-750144, 1065918-1065921, 1165621, 1165878, and 1263532-1263557 are complementary to a portion of nucleobases 483,965-484,003 of SEQ ID NO: 1.

In certain embodiments, modified oligonucleotides complementary to a portion of nucleobases 483,965-484,003 of SEQ ID NO: 1 achieve at least 24% reduction of UBE3A-ATS RNA in vitro in the standard cell assay. In certain embodiments, modified oligonucleotides complementary to nucleobases 483,965-484,003 of SEQ ID NO: 1 achieve an average of 65% reduction of UBE3A-ATS RNA in vitro in the standard cell assay. In certain embodiments, modified oligonculeotides complementary to a portion of nucleobases 468,968-469,013 of SEQ ID NO: 1 achieve an average of 330% upregulation of UBE3A-ATS RNA in vitro at 6.7 µM in cell culture.

4. Additional Hotspot Regions

In certain embodiments, the ranges described in the Table below comprise hotspot regions. Each hotspot region begins with the nucleobase of SEQ ID NO: 1 identified in the "Start Site SEQ ID NO: 1" column and ends with the nucleobase of SEQ ID NO: 1 identified in the "Stop Site SEQ ID NO: 1" column In certain embodiments, modified oligonucleotides are complementary within any of the hotspot regions 1-61, as defined in the table below. In certain embodiments, modified oligonucleotides are 18 nucleobases in length. In certain embodiments, modified oligonucleotides are 20 nucleobases in length. In certain embodiments, modified oligonucleotides are gapmers. In certain embodiments, modified oligonucleotides are 4-8-6, 6-8-4, 5-8-5, 4-10-6, 6-10-4, or 5-10-5 MOE gapmers.

The nucleobase sequence of compounds listed in the "Compound ID in range" column in the table below are complementary to SEQ ID NO: 1 within the specified hotspot region. The nucleobase sequence of the oligonucleotides listed in the "SEQ ID NO: in range" column in the table below are complementary to the target sequence, SEQ ID NO: 1, within the specified hotspot region.

In certain embodiments, modified oligonucleotides complementary to nucleobases within the hotspot region achieve at least "Min. % Red " (minimum % reduction, relative to untreated control cells) of UBE3A-ATS RNA in vitro in the standard cell assay, as indicated in the table below. In certain embodiments, modified oligonucleotides complementary to nucleobases within the hotspot region achieve an average of "Avg. % Red." (average % reduction, relative to untreated control cells) of UBE3A-ATS RNA in vitro in the standard cell assay, as indicated in the table below. In certain embodiments, modified oligonucleotides complementary to nucleobases within the hotspot region achieve a maximum of "Max. % Red." (maximum % reduction, relative to untreated control cells) of UBE3A-ATS RNA in vitro in the standard cell assay, as indicated in the table below.

TABLE 1

UBE3A-ATS Hotspots

| Hotspot ID | Start Site SEQ ID NO: 1 | Stop Site SEQ ID NO: 1 | Min. % Red. | Max. % Red. | Avg. % Red. | Compound ID in range | SEQ ID NO: in range |
|---|---|---|---|---|---|---|---|
| 1 | 461413 | 461487 | 36 | 89 | 60 | 749901-749904, 1065641-1065646, 1165562-1165563, 1165857-1165858, 1273001 | 1053, 1329, 1501, 1576, 1873, 1949, 2025, 2096, 2245, 2512, 2591, 2680-2682, 2844 |
| 2 | 468968 | 469013 | 75 | 81 | 78 | 750031-750032, 1263408-1263411, 1263426, 1263441, 1263460-1263465, 1263486-1263492, 1263517-1263523, 1273061, 1273062, 1273065-1273067 | 376, 377, 2751-2756, 2773-2776, 2872, 2873, 2876-2878 |
| 3 | 483965 | 484003 | 24 | 91 | 65 | 617557, 699781, 750138-750144, 1065918-1065921, 1165621, 1165878, 1263532-1263557 | 172, 764-770, 995, 1445, 1668, 1743, 2255, 2595, 2762-2767 |
| 4 | 349103# | 349150# | 35 | 82 | 56 | 750519-750533 | 181-195 |
| 5 | 457354 | 457405 | 37 | 85 | 66 | 749848, 1065574-1065576, 1165519-1165521, 1179839-1179840 | 552, 973, 1273, 1795, 2162, 2237, 2370, 2537, 2671 |
| 6 | 457899 | 457936 | 49 | 77 | 59 | 749852, 1065581-1065582 | 556, 1497, 1945 |
| 7 | 457969 | 458013 | 36 | 78 | 61 | 749853, 1065583-1065586, 1165523-1165525 | 557, 1124, 1199, 1647, 2021, 2089, 2464, 2538 |
| 8 | 458523 | 458558 | 64 | 77 | 71 | 749861-749862, 1065595 | 565, 566, 1050 |
| 9 | 458560 | 458627 | 45 | 81 | 64 | 749863-749867, 1065596-1065600, 1272999 | 567-571, 1125, 1498, 1573, 1946, 2022, 2842 |
| 10 | 458935 | 458976 | 30 | 85 | 60 | 1065602-1065605, 1165530-1165540, 1165853 | 901, 1425, 1648, 1724, 2091, 2092, 2164, 2165, 2239, 2240, 2392-2393, 2465, 2511, 2539, 2540 |
| 11 | 460105 | 460137 | 43 | 82 | 60 | 749882, 1065615-1065619, 1165547-1165549 | 586, 1126, 1201, 1649, 1725, 2023, 2093, 2467, 2542 |
| 12 | 460348 | 460381 | 36 | 77 | 58 | 1065621-1065622, 1165550-1165551 | 902, 976, 2167, 2242 |
| 13 | 460641 | 460686 | 50 | 67 | 57 | 617531, 1065629-1065631 | 107, 1500, 1948, 2024 |
| 14 | 460974 | 461021 | 75 | 91 | 82 | 749893-749894, 1165855, 1263451-1263455, | 597, 598, 2219, 2745-2749 |

TABLE 1-continued

UBE3A-ATS Hotspots

| Hotspot ID | Start Site SEQ ID NO: 1 | Stop Site SEQ ID NO: 1 | Min. % Red. | Max. % Red. | Avg. % Red. | Compound ID in range | SEQ ID NO: in range |
|---|---|---|---|---|---|---|---|
| | | | | | | 1263473-1263478, 1263504-1263509 | |
| 15 | 461597 | 461627 | 50 | 85 | 68 | 1065651-1065655 | 904, 978, 1278, 1428, 1800 |
| 16 | 463502 | 463531 | 60 | 71 | 66 | 749931, 1065674-1065675 | 1503, 1578, 2708 |
| 17 | 463826 | 463872 | 50 | 71 | 62 | 749938, 749939, 1065680 | 1728, 2714, 2715 |
| 18 | 464377 | 464428 | 32 | 77 | 58 | 749951, 1065684-1065687, 1165572-1165577, 1273006-1273008 | 1280, 1356, 1802, 1876, 2097, 2172, 2247, 2398, 2471, 2546, 2727, 2849-2851 |
| 19 | 464522 | 464575 | 47 | 77 | 62 | 749952-749954, 1065690, 1165578, 1263412-1263416, 1263427-1263431, 1263442-1263446, 1263466-1263469, 1263494-1263499, 1263524-1263530, 1273068-1273070 | 1504, 2098, 2728-2730, 2757-2760, 2777-2781, 2879-2881 |
| 20 | 464994 | 465032 | 27 | 76 | 52 | 617457, 749957-749964, 1065698-1065702, 1165866 | 33, 907, 981, 1281, 1357, 1877, 2136, 2733-2739 |
| 21 | 465231 | 465266 | 23 | 83 | 63 | 749969, 1065706-1065713, 1165583-1165587, 1263403-1263407, 1263421-1263425, 1263436-1263440, 1263456, 1263479-1263485, 1263510-1263516, 1273063, 1273064 | 318, 908, 1132, 1207, 1432, 1655, 1730, 1953, 2028, 2174, 2248, 2400, 2473, 2548, 2750, 2768-2772, 2875 |
| 22 | 465372 | 465413 | 33 | 73 | 54 | 749972, 1065717-1065719, 1165588-1165592, 1165867-1165869 | 321, 1058, 1358, 1878, 2099, 2137, 2175, 2249, 2401, 2475, 2514, 2593 |
| 23 | 465600 | 465631 | 65 | 68 | 67 | 749975, 1065727-1065728, 1272944-1272947 | 324, 1433, 1731, 2787-2790 |
| 24 | 466244 | 466282 | 38 | 68 | 54 | 1065742-1065744, 1165595-1165598 | 1434, 1657, 1732, 2176, 2251, 2403, 2549 |
| 25 | 466529 | 466570 | 31 | 80 | 57 | 617460, 749989-749998, 1065760-1065762 | 36, 338-346, 911, 985, 1435 |
| 26 | 466979 | 467014 | 51 | 75 | 65 | 617461, 750000-750005, 1065764 | 37, 347-351, 1806 |
| 27 | 467043 | 467095 | 44 | 93 | 69 | 617539, 750006, 1065765-1065767, 1272943, 1272960, 1273005 | 115, 352, 1061, 1361, 1881, 2786, 2803, 2848 |
| 28 | 468335 | 468372 | 42 | 68 | 56 | 1065781-1065783, 1165609, 1165875 | 1062, 1362, 1882, 2139, 2405 |
| 29 | 475827 | 475877 | 39 | 71 | 57 | 617470, 1065830-1065834 | 46, 1065, 1365, 1513, 1588, 1961 |
| 30 | 482148 | 482181 | 49 | 70 | 68 | 750122, 1065889-1065890, 1165612 | 748, 919, 993, 2406 |
| 31 | 487589 | 487629 | 73 | 79 | 76 | 750172, 1065953-1065955, 1272973, 1272974 | 798, 997, 1297, 1818, 2816, 2817 |
| 32 | 487772 | 487826 | 44 | 73 | 62 | 750175-750177, 1065957 | 801-803, 1373 |
| 33 | 489873 | 489927 | 52 | 73 | 59 | 750195-750196, 1065989 | 398, 399, 1375 |
| 34 | 493831 | 493860 | 44 | 63 | 56 | 750202-750204 | 405-407 |
| 35 | 499081 | 499119 | 47 | 70 | 55 | 1066036-1066038 | 1078, 1378, 1898 |
| 36 | 500605 | 500658 | 36 | 66 | 58 | 750265-750266, 1066064-1066065 | 683, 684, 929, 1004 |
| 37 | 500846 | 500905 | 30 | 86 | 55 | 750269-750270, 1066073-1066077, 1165670 | 687-688, 1155, 1230, 1678, 1976, 2051, 2562 |
| 38 | 501335 | 501375 | 42 | 67 | 56 | 1066091-1066094, 1272975-1272977 | 1156, 1231, 1679, 1753, 2818-2820 |
| 39 | 502125 | 502157 | 65 | 79 | 72 | 750291, 1066119-1066121 | 708, 1531, 1606, 1979 |
| 40 | 502194 | 502228 | 51 | 88 | 65 | 750292, 1066124-1066125 | 709, 1233, 1681 |
| 41 | 502416 | 502452 | 49 | 59 | 54 | 1066130-1066132 | 1308, 1829, 1904 |
| 42 | 502580 | 502618 | 57 | 59 | 58 | 750295, 1066140-1066142 | 712, 1234, 1682, 1756 |
| 43 | 503427 | 503461 | 36 | 73 | 61 | 750301, 1066185, 1165724 | 718, 1983, 2197 |
| 44 | 503636 | 503675 | 55 | 72 | 62 | 750307-750308, 1066190 | 724, 725, 1759 |
| 45 | 503973 | 504034 | 20 | 81 | 56 | 617503-617505, 617581-617582, 750313-750324, 750383, 1066202 | 79-81, 155-157, 302, 731-736, 2059 |
| 46 | 504088 | 504122 | 45 | 85 | 65 | 750325-750327, 1066206 | 245, 246, 737, 1760 |
| 47 | 504431 | 504460 | 49 | 70 | 57 | 1066218-1066219, 1165736-1165740 | 1164, 2060, 2119, 2276, 2427, 2495, 2574 |
| 48 | 506031 | 506071 | 33 | 66 | 52 | 750356, 750357, 1066274-1066276 | 275, 276, 1317, 1838, 1913 |
| 49 | 508739 | 508780 | 20 | 83 | 56 | 617503-617504, 617580-617582, 750313-750323, 750383, 1066202 | 79, 80, 155-157, 302, 730-735, 2059 |

TABLE 1-continued

UBE3A-ATS Hotspots

| Hot-spot ID | Start Site SEQ ID NO: 1 | Stop Site SEQ ID NO: 1 | Min. % Red. | Max. % Red. | Avg. % Red. | Compound ID in range | SEQ ID NO: in range |
|---|---|---|---|---|---|---|---|
| 50 | 509208 | 509271 | 46 | 68 | 63 | 750394-750395, 1066377-1066378 | 313-314, 1995, 2070 |
| 51 | 510203 | 510247 | 36 | 77 | 60 | 750400-750401, 1066394-1066395, 1165828 | 810, 811, 1175, 2071, 2440 |
| 52 | 510832 | 510872 | 44 | 70 | 55 | 1066418-1066421 | 1326, 1402, 1847, 1922 |
| 53 | 513442 | 513486 | 66 | 81 | 72 | 750436-750439 | 846-849 |

The oligonucleotides described in this section are complementary to this hotspot region at multiple sites. These sites are described in detail in Table 4b herein below (Example 1).

Nonlimiting Disclosure and Incorporation by Reference

Each of the literature and patent publications listed herein is incorporated by reference in its entirety.

While certain compounds, compositions and methods described herein have been described with specificity in accordance with certain embodiments, the following examples serve only to illustrate the compounds described herein and are not intended to limit the same. Each of the references, GenBank accession numbers, and the like recited in the present application is incorporated herein by reference in its entirety.

Although the sequence listing accompanying this filing identifies each sequence as either "RNA" or "DNA" as required, in reality, those sequences may be modified with any combination of chemical modifications. One of skill in the art will readily appreciate that such designation as "RNA" or "DNA" to describe modified oligonucleotides is, in certain instances, arbitrary. For example, an oligonucleotide comprising a nucleoside comprising a 2'-OH sugar moiety and a thymine base could be described as a DNA having a modified sugar (2'-OH in place of one 2'-H of DNA) or as an RNA having a modified base (thymine (methylated uracil) in place of an uracil of RNA). Accordingly, nucleic acid sequences provided herein, including, but not limited to those in the sequence listing, are intended to encompass nucleic acids containing any combination of natural or modified RNA and/or DNA, including, but not limited to such nucleic acids having modified nucleobases. By way of further example and without limitation, an oligomeric compound having the nucleobase sequence "ATCGATCG" encompasses any oligomeric compounds having such nucleobase sequence, whether modified or unmodified, including, but not limited to, such compounds comprising RNA bases, such as those having sequence "AUCGAUCG" and those having some DNA bases and some RNA bases such as "AUCGATCG" and oligomeric compounds having other modified nucleobases, such as "AT$^m$CGAUCG," wherein $^m$C indicates a cytosine base comprising a methyl group at the 5-position.

Certain compounds described herein (e.g., modified oligonucleotides) have one or more asymmetric center and thus give rise to enantiomers, diastereomers, and other stereoisomeric configurations that may be defined, in terms of absolute stereochemistry, as (R) or (S), as α or β such as for sugar anomers, or as (D) or (L), such as for amino acids, etc. Compounds provided herein that are drawn or described as having certain stereoisomeric configurations include only the indicated compounds. Compounds provided herein that are drawn or described with undefined stereochemistry include all such possible isomers, including their stereorandom and optically pure forms, unless specified otherwise. Likewise, tautomeric forms of the compounds herein are also included unless otherwise indicated. Unless otherwise indicated, compounds described herein are intended to include corresponding salt forms.

The compounds described herein include variations in which one or more atoms are replaced with a non-radioactive isotope or radioactive isotope of the indicated element. For example, compounds herein that comprise hydrogen atoms encompass all possible deuterium substitutions for each of the 41 hydrogen atoms. Isotopic substitutions encompassed by the compounds herein include but are not limited to: $^2$H or $^3$H in place of $^1$H, $^{13}$C or $^{14}$C in place of $^{12}$C, $^{15}$N in place of $^{14}$N, $^{17}$O or $^{18}$O in place of $^{16}$O and $^{33}$S, $^{34}$S, $^{35}$S, or $^{36}$S in place of $^{32}$S. In certain embodiments, non-radioactive isotopic substitutions may impart new properties on the oligomeric compound that are beneficial for use as a therapeutic or research tool. In certain embodiments, radioactive isotopic substitutions may make the compound suitable for research or diagnostic purposes such as imaging.

EXAMPLES

The following examples illustrate certain embodiments of the present disclosure and are not limiting. Moreover, where specific embodiments are provided, the inventors have contemplated generic application of those specific embodiments. For example, disclosure of an oligonucleotide having a particular motif provides reasonable support for additional oligonucleotides having the same or similar motif. And, for example, where a particular high-affinity modification appears at a particular position, other high-affinity modifications at the same position are considered suitable, unless otherwise indicated.

Example 1

Effect of 5-10-5 MOE Gapmer Modified Oligonucleotides on Human UBE3A-ATS RNA In Vitro, Single Dose Modified oligonucleotides complementary to human UBE3A-ATS nucleic acid were tested for their effect on UBE3A-ATS RNA levels in vitro.

The modified oligonucleotides in the tables below are 5-10-5 MOE gapmers. The gapmers are 20 nucleosides in length, wherein the central gap segment consists of ten 2'-β-D-deoxynucleosides and the 5' and 3' wing segments each consists of five 2'-MOE nucleosides. The sugar motif for the gampers is (from 5' to 3'): eeeeedddddddddeeeee; wherein 'd' represents a 2'-β-D-deoxyribosyl sugar moiety, and 'e' represents a 2'-MOE sugar moiety.

Each internucleoside linkage of Compound IDs 617441-617596 (in Tables 2 and 3) is a phosphorothioate internucleoside linkage. All other compounds (Tables 4-33) have an internucleoside linkage motif of (from 5' to 3'): sooooossssssssssooss, wherein each "s" represents a phosphorothioate internucleoside linkage and each "o" represents a phosphodiester internucleoside linkage.

All cytosine residues are 5-methylcytosines.

"Start site" indicates the 5'-most nucleoside to which the modified oligonucleotide is complementary in the human gene sequence. "Stop site" indicates the 3'-most nucleoside to which the modified oligonucleotide is complementary in the target nucleic acid sequence. Each modified oligonucleotide listed in the Tables below is 100% complementary to SEQ ID NO: 1 (GENBANK Accession No NC_000015.10 truncated from nucleotides 24821647 to 25441028). Selected compounds in the table below are complementary to the target nucleic acid sequence at more than three specific sites. For these compounds, the "start site" and "stop site" values in the Tables below are indicated with a hashtag (#) and indicate only the first site to which the compound is complementary. Additional sites to which these compounds are complementary are indicated in Table 4b below.

Human IPSC cell derived iCell GABANeurons (Cellular Dynamics) were cultured per manufacturer instructions at 20,000-60,000 cells per well (as indicated in the table heading) and were treated with 5,000-10,000 nM of modified oligonucleotide (as indicated in the table heading) by free uptake. After a treatment period of approximately 6 days, total RNA was isolated from the cells and UBE3A-ATS RNA levels were measured by quantitative real-time RTPCR. Human UBE3A-ATS primer probe set RTS4796 (forward sequence CTCCCCCAGTTCTGGAATGA, designated herein as SEQ ID NO: 2; reverse sequence TACACAGGGATTTGAGCCTGCTA, designated herein as SEQ ID NO: 3; probe sequence CCCACAGATCAAGCATTCCCCAAAGA, designated herein as SEQ ID NO: 4) was used to measure RNA levels. UBE3A-ATS RNA levels were normalized to total RNA content, as measured by RIBOGREEN®. Reduction of UBE3A-ATS RNA is presented in the tables below as percent UBE3A-ATS RNA amount relative to untreated control (UTC) cells. Each table represents results from an individual assay plate. The values marked with an asterisk (*) indicate that the modified oligonucleotide is complementary to the amplicon region of the primer probe set. Additional assays may be used to measure the potency and efficacy of the modified oligonucleotides complementary to the amplicon region. "N.D." indicates that a value was not determined in this experiment due to experimental error. However, activities of selected modified oligonucleotides, including those that are not defined in Example 1, are successfully demonstrated in dose-response studies herein below.

TABLE 2

Reduction of UBE3A-ATS RNA by 7,000 nM 5-10-5 MOE gapmers with PS internucleoside linkages in vitro (60,000 cells/well)

| Compound Number | SEQ ID NO: 1 Start Site | SEQ ID NO: 1 Stop Site | Sequence (5' to 3') | UBE3A-ATS (% UTC) | SEQ ID NO |
|---|---|---|---|---|---|
| 617441 | 449466 | 449485 | ATGTTGCTTGCACTCCATCA | 85 | 17 |
| 617442 | 449945 | 449964 | ACAACATAAGGTCTTATTGT | 87 | 18 |
| 617443 | 450581 | 450600 | TTTTCAACTCCAGAATTTTC | 87 | 19 |
| 617444 | 451644 | 451663 | TTCAGTCTTATACAGAAATG | 94 | 20 |
| 617445 | 452473 | 452492 | GGACTGACACAGAAAACTGG | 115 | 21 |
| 617446 | 454843 | 454862 | AGGGTAGAAGACTAGCATAC | 111 | 22 |
| 617447 | 455272 | 455291 | GGCCATTCATTCAGCCACAC | 95 | 23 |
| 617448 | 455405 | 455424 | TAAAGATTTTATGAAAATAC | 104 | 24 |
| 617449 | 456040 | 456059 | TTTAGAACATGTGAATTTCA | 109 | 25 |
| 617450 | 457025 | 457044 | AGACATATCACAGTTGCTTG | 89 | 26 |
| 617451 | 457601 | 457620 | AATATAATGTAGTATGACCA | 59 | 27 |
| 617452 | 458989 | 459008 | GAGGACACTGGCACATCTAT | 59 | 28 |
| 617453 | 459376 459401 | 459395 459420 | TTAAATAATAAAATATATTT | 108 | 29 |
| 617454 | 461190 | 461209 | ATTGGAGCAAAAAGGGATCA | 45 | 30 |
| 617455 | 462327 | 462346 | AATTATTCCCTATATCCTGT | 45 | 31 |
| 617456 | 463905 | 463924 | CAACTGTTACCAAGACTTCA | 24 | 32 |
| 617457 | 465003 | 465022 | ATCTGCGAATAGAGGCCCTC | 44 | 33 |
| 617458 | 465460 | 465479 | AAGGTTTTTATTTCATCACT | 68 | 34 |
| 617459 | 465872 | 465891 | GCCCATGGATGGTTGTCAAA | 34 | 35 |
| 617460 | 466539 | 466558 | TAGGTTGCATAAAGCCAGGC | 23 | 36 |

TABLE 2-continued

Reduction of UBE3A-ATS RNA by 7,000 nM 5-10-5 MOE gapmers with PS internucleoside linkages in vitro (60,000 cells/well)

| Compound Number | SEQ ID NO: 1 Start Site | SEQ ID NO: 1 Stop Site | Sequence (5' to 3') | UBE3A-ATS (% UTC) | SEQ ID NO |
|---|---|---|---|---|---|
| 617461 | 466981 | 467000 | CACACATCTTGTTCCCTCAA | 23 | 37 |
| 617462 | 467508 | 467527 | TTTTTTTAATCCTCTGATGA | 123 | 38 |
| 617463 | 467914 | 467933 | AGTCTCTTTTCTTTCGGTGC | 34 | 39 |
| 617464 | 468085 | 468104 | GGAAAGTTCTTCTCTCTCCT | 69 | 40 |
| 617465 | 469204 | 469223 | ATTTGGTCTAAAGTGAAGTT | 91 | 41 |
| 617466 | 470003 | 470022 | TTTTGTGAGATTTTTGAATA | 101 | 42 |
| 617467 | 471815 | 471834 | TGTTAAATGCTTTTCTAAAT | 80 | 43 |
| 617468 | 472985 | 473004 | CTGATGATTGATTGTTTCCT | 71 | 44 |
| 617469 | 474868 | 474887 | TATGATAATGTGTAGTTTTT | 110 | 45 |
| 617470 | 475850 | 475869 | AAGGGTAATACGGACCTCAT | 29 | 46 |
| 617471 | 476475 | 476494 | CTATTTTTGCTTCCCTTAT | 56 | 47 |
| 617472 | 479448 | 479467 | GAATTCTTAGAAAGTTAATT | 118 | 48 |
| 617473 | 479585 | 479604 | TGCCATCTTCAAGACTAAGG | 33 | 49 |
| 617474 | 480527 | 480546 | AATGGAAAAGATGTATCACG | 92 | 50 |
| 617475 | 481063 | 481082 | AACTTTGGCAGCTATTCAAT | 88 | 51 |
| 617476 | 481522 | 481541 | GACACTAGGTTTTGCAAAAG | 63 | 52 |
| 617477 | 481663 | 481682 | TATGAATTTTCAATTCAATG | 155 | 53 |
| 617478 | 483415 | 483434 | CACTTAAGGGAACTTTCAGA | 84 | 54 |
| 617479 | 483933 | 483952 | GAGATGATGTTAAGCTTTCA | 75 | 55 |
| 617480 | 484344 | 484363 | TAAGACAAGTGGCCATGAAG | 92 | 56 |
| 617481 | 484760 | 484779 | CTCTGTTCTGTCTCAAAACA | 47 | 57 |
| 617482 | 485496 | 485515 | TATAAGAAAGAAGATTACAG | 132 | 58 |
| 617483 | 486358 | 486377 | AAATGTTAATAGACTGCGAT | 93 | 59 |
| 617484 | 486941 | 486960 | TTAAACTCCCCAGTCAAAAG | 108 | 60 |
| 617485 | 488180 | 488199 | ATTTACTTCAAACAGGAGCT | 42 | 61 |
| 617486 | 489476 | 489495 | TCAGGAAATTAAAGCATTCA | 81 | 62 |
| 617487 | 489630 | 489649 | CCTAACCTGGATCTCAGATA | 57 | 63 |
| 617488 | 493552 | 493571 | TACAGCAACCCTAGAAAACT | 121 | 64 |
| 617489 | 493893 | 493912 | ATCTTTGGCAGATGTAACCT | 63 | 65 |
| 617490 | 495750 | 495769 | GAGTATTATCCAAAAGAACA | 83 | 66 |
| 617491 | 497275 | 497294 | AAAGCCCAGGATTAGGCAGC | 63 | 67 |
| 617492 | 497366 | 497385 | CTACAAAGAGTGAATCATGA | 130 | 68 |
| 617493 | 498003 | 498022 | TAATCTTAAGTTTAAGTGGA | 68 | 69 |
| 617494 | 498883 | 498902 | AAAAGACATAGAATGACAG | 100 | 70 |
| 617495 | 499237 | 499256 | AGATACAAATTTAAAAAAGT | 119 | 71 |
| 617496 | 499672 | 499691 | GGTAGCCCCAATACAGATTC | 62 | 72 |

TABLE 2-continued

Reduction of UBE3A-ATS RNA by 7,000 nM 5-10-5 MOE gapmers with PS internucleoside linkages in vitro (60,000 cells/well)

| Compound Number | SEQ ID NO: 1 Start Site | SEQ ID NO: 1 Stop Site | Sequence (5' to 3') | UBE3A-ATS (% UTC) | SEQ ID NO |
|---|---|---|---|---|---|
| 617497 | 500044 | 500063 | CTTCAACAGCAGACTTGATC | 65 | 73 |
| 617498 | 501513 | 501532 | GGTCCACACAGAGTTCAAAT | 73 | 74 |
| 617499 | 501703 | 501722 | CTTTGGGACATCCCAAAGTT | 113 | 75 |
| 617500 | 502388 | 502407 | TACACATCTTGTATACAAGG | 60 | 76 |
| 617501 | 503258 | 503277 | TAATACTTTCTTGAGTAATA | 124 | 77 |
| 617502 | 503904 | 503923 | GGGTGGTTGGATTGCTTTAT | 47 | 78 |
| 617503 | 503977 508743 | 503996 508762 | CTGCACACTGTACAGGAGGG | 80 | 79 |
| 617504 | 503985 508751 | 504004 508770 | TTGATTCACTGCACACTGTA | 67 | 80 |
| 617505 | 504015 | 504034 | GTGCAGGAAGGAGGTTTTGT | 55 | 81 |
| 617506 | 504943 | 504962 | ATACAGTATATACATCATCC | 42 | 82 |
| 617507 | 505266 | 505285 | AAGTTTAAAACAAAAAAAGG | 119 | 83 |
| 617508 | 507068 | 507087 | AATGTCTGTTCTTTGTGGTA | 91 | 84 |
| 617509 | 507897 | 507916 | ATACCTGCTTTTGTGACAAT | 75 | 85 |
| 617510 | 508556 | 508575 | GAGTGTAGCTCATTTCAGAA | 74 | 86 |
| 617511 | 509785 | 509804 | TTTCTCAATGTCAACTCTCA | 68 | 87 |
| 617512 | 510721 | 510740 | CAAGCCGAATCTTGACATAC | 73 | 88 |
| 617513 | 511227 | 511246 | GACCAGAAAAGCTACATAGC | 87 | 89 |
| 617514 | 512575 | 512594 | ATTTTGTATATTGTAGCTTT | 105 | 90 |
| 617515 | 513295 | 513314 | CCATCTTTCTGTTATCTTGT | 51 | 91 |
| 617516 | 513982 | 514001 | CTTTGTTTCTTTTTAAGAAA | 108 | 92 |
| 617517 | 514259 | 514278 | ACCTTGACAACACCCTAGCT | 89 | 93 |
| 617518 | 515123 | 515142 | AAAAAGGAACCATAAACTAA | 117 | 94 |

TABLE 3

Reduction of UBE3A-ATS RNA by 7,000 nM 5-10-5 MOE gapmers with PS internucleoside linkages in vifro (60,000 cells/well)

| Compound Number | SEQ ID NO: 1 Start Site | SEQ ID NO: 1 Stop Site | Sequence (5' to 3') | UBE3A-ATS (% UTC) | SEQ ID NO |
|---|---|---|---|---|---|
| 617461 | 466981 | 467000 | CACACATCTTGTTCCCTCAA | 29 | 37 |
| 617519 | 449812 | 449831 | GGTGTGTCAGCTGTGCTGGT | 62 | 95 |
| 617520 | 450498 | 450517 | ATCATACCTTCACTTTTTTT | 101 | 96 |
| 617521 | 450896 | 450915 | TTCATTGAGCTTCCTGGATA | 100 | 97 |
| 617522 | 451804 | 451823 | TTACTTCTTTTTCATTAAGT | 86 | 98 |
| 617523 | 454628 | 454647 | AGTAAACACTCCAACAAAAA | 126 | 99 |
| 617524 | 455049 | 455068 | GGTCTAAGCAAAATGTGAAG | 137 | 100 |
| 617525 | 455323 | 455342 | CAGTTAGGCCTGCTCCGAAT | 102 | 101 |

TABLE 3-continued

Reduction of UBE3A-ATS RNA by 7,000 nM 5-10-5 MOE gapmers with PS internucleoside linkages in vitro (60,000 cells/well)

| Compound Number | SEQ ID NO: 1 Start Site | SEQ ID NO: 1 Stop Site | Sequence (5' to 3') | UBE3A-ATS (% UTC) | SEQ ID NO |
|---|---|---|---|---|---|
| 617526 | 455499 | 455518 | ACTCTGAAAATAGCCAATTT | 134 | 102 |
| 617527 | 456944 | 456963 | AGTATCTATCTACAATTAAA | 112 | 103 |
| 617528 | 457237 | 457256 | AATGGCTTAGCTACTCACCC | 72 | 104 |
| 617529 | 458254 | 458273 | CCTCTCTGCAAAACAAGAGA | 74 | 105 |
| 617530 | 459153 | 459172 | ATTACTCATTCTGGGAATGC | 35 | 106 |
| 617531 | 460667 | 460686 | GTTTTCAGCATGATTCTAAC | 46 | 107 |
| 617532 | 461259 | 461278 | CATATATAAAAATTAGAATG | 122 | 108 |
| 617533 | 463621 | 463640 | AATGCCACAAAGCTGGCTGT | 97 | 109 |
| 617534 | 464514 | 464533 | GTGCACAGATAATGACTAGA | 69 | 110 |
| 617535 | 465402 | 465421 | CAGTGAGAAGTCAATTGTCA | 67 | 111 |
| 617536 | 465580 | 465599 | TCCTTTAGCATTTCTATTAG | 28 | 112 |
| 617537 | 466423 | 466442 | AACATGTGCTTGCAAGCCAT | 46 | 113 |
| 617538 | 466701 | 466720 | AAATAACTGGATCTCATAAC | 55 | 114 |
| 617539 | 467064 | 467083 | CTTAGGAGAGAAACACTTTC | 56 | 115 |
| 617540 | 467546 | 467565 | TACATCCTGTAGGCTTTCTT | 55 | 116 |
| 617541 | 467961 | 467980 | ACTGAGAAATCTCTTGAATG | 92 | 117 |
| 617542 | 468624 | 468643 | TTGCTCTTTTTACTTTGTTC | 37 | 118 |
| 617543 | 469731 | 469750 | ACTCTAAGTTTTATTAATAG | 105 | 119 |
| 617544 | 470091 | 470110 | TTTGGAAGAGCTTAATAAAG | 110 | 120 |
| 617545 | 472023 | 472042 | TAGCTAGAATTTCAACTACT | 63 | 121 |
| 617546 | 474443 | 474462 | ATGTAGTATTTATTTCATTT | 120 | 122 |
| 617547 | 474957 | 474976 | GCCTAATATGTGTCATCCTG | 28 | 123 |
| 617548 | 475998 | 476017 | CCTCAATTCTATGGTTAGTT | 52 | 124 |
| 617549 | 479376 | 479395 | TCTTGGAGATGACTTCTCTG | 75 | 125 |
| 617550 | 479580 | 479599 | TCTTCAAGACTAAGGTAGGG | 54 | 126 |
| 617551 | 479654 | 479673 | AGTAAGGTCTGTTATTCTCC | 35 | 127 |
| 617552 | 480998 | 481017 | GCTATACAACAAAAAGAATT | 123 | 128 |
| 617553 | 481073 | 481092 | ACTGTGGAAAAACTTTGGCA | 54 | 129 |
| 617554 | 481582 | 481601 | ATAATCTACATGTATAGACC | 85 | 130 |
| 617555 | 481984 | 482003 | AAAGCCAATTCTGAAATTC | 44 | 131 |
| 617556 | 483689 | 483708 | ATTCTCCTACCTCTCAGCCT | 107 | 132 |
| 617558 | 484654 | 484673 | AACTGTAGCAAATATACTAC | 110 | 133 |
| 617559 | 485236 | 485255 | AAATTACTGCTCTGTAAAAG | 93 | 134 |
| 617560 | 485886 | 485905 | GATTCAATGAAATAAAAAAT | 144 | 135 |
| 617561 | 486894 | 486913 | AATGACATAGCTTATGCTGT | 104 | 136 |
| 617562 | 488162 | 488181 | CTAGAAATTAAGACATCCCT | 63 | 137 |

TABLE 3-continued

Reduction of UBE3A-ATS RNA by 7,000 nM 5-10-5 MOE gapmers with PS internucleoside linkages in vitro (60,000 cells/well)

| Compound Number | SEQ ID NO: 1 Start Site | SEQ ID NO: 1 Stop Site | Sequence (5' to 3') | UBE3A-ATS (% UTC) | SEQ ID NO |
|---|---|---|---|---|---|
| 617563 | 488563 | 488582 | GCCACACCATCAAAAGAACC | 77 | 138 |
| 617564 | 489518 | 489537 | TGGACCACCTAAGACCTCAA | 62 | 139 |
| 617565 | 489731 | 489750 | ACCGGTTCCCAATTTTCTCC | 82 | 140 |
| 617566 | 493655 | 493674 | GAGAGAATACGGCCCTGATG | 77 | 141 |
| 617567 | 494790 | 494809 | AACTTCAATCAGAGTAATAT | 117 | 142 |
| 617568 | 496045 | 496064 | GGCAAAGGAATGAAGAGACC | 69 | 143 |
| 617569 | 497328 | 497347 | GCCAATAACAAGAAAAGAGA | 96 | 144 |
| 617570 | 497416 | 497435 | ATCAAATTGGATGACCTAAA | 122 | 145 |
| 617571 | 498140 | 498159 | CAATGGATTTCAATTACACT | 54 | 146 |
| 617572 | 498893 | 498912 | ATTCTCCAACAAAAAGACAT | 93 | 147 |
| 617573 | 499276 | 499295 | GTAGCTACAAGAAGTAATTG | 117 | 148 |
| 617574 | 499958 | 499977 | AAAGAATGCCTATAAGAATT | 118 | 149 |
| 617575 | 500578 | 500597 | CTACTGGCATCAGTCAAAAC | 60 | 150 |
| 617576 | 501578 | 501597 | AAAGGCAAGGCTAAGGAGT | 69 | 151 |
| 617577 | 502305 | 502324 | CCCACACAGGTCATTCATTC | 52 | 152 |
| 617578 | 503150 | 503169 | TGTATACACCATCCCAGAAA | 93 | 153 |
| 617579 | 503795 | 503814 | AAAATGCCAGTTTGTTGTAC | 60 | 154 |
| 617580 | 503973 508739 | 503992 508758 | ACACTGTACAGGAGGGTGTC | 69 | 155 |
| 617581 | 503981 508747 | 504000 508766 | TTCACTGCACACTGTACAGG | 70 | 156 |
| 617582 | 503993 508759 | 504012 508778 | AAATGATGTTGATTCACTGC | 36 | 157 |
| 617583 | 504551 | 504570 | AGAGTTTTCATGAATTCAGG | 46 | 158 |
| 617584 | 505011 | 505030 | GGTTTCTTTCATTAAATAGC | 63 | 159 |
| 617585 | 506396 | 506415 | GAGGCAACTCCTGAGAGCTG | 64 | 160 |
| 617586 | 507650 | 507669 | TTAAATGTCAGGAGGTCCCC | 57 | 161 |
| 617587 | 508201 | 508220 | TGTCATCTGATCTCACACAT | 86 | 162 |
| 617588 | 508772 | 508791 | CAAAGTCCAAGGGAAATGAT | 71 | 163 |
| 617589 | 510010 | 510029 | CACAGTAGAGGCAAATGAGA | 79 | 164 |
| 617590 | 511058 | 511077 | GACATTTAGGATGATGATAT | 72 | 165 |
| 617591 | 512158 | 512177 | GTTGTATTAATGGACTTTTG | 65 | 166 |
| 617592 | 513203 | 513222 | ATTTTTTGCATAAGTGCATT | 86 | 167 |
| 617593 | 513508 | 513527 | ACATTTCTTAGTTGAACAGT | 29 | 168 |
| 617594 | 514104 | 514123 | AGATTCTTCCCCAATCCCAT | 81 | 169 |
| 617595 | 514524 | 514543 | CTCACTTGTCTCCTTTTACC | 73 | 170 |
| 617596 | 515282 | 515301 | ACAATAAGGAAGAGCAAAAC | 104 | 171 |

TABLE 4

Reduction of UBE3A-ATS RNA by 5,000 nM 5-10-5 MOE gapmers with mixed PO/PS internucleoside linkages in vitro (35,000 cells/well)

| Compound Number | SEQ ID NO: 1 Start Site | SEQ ID NO: 1 Stop Site | Sequence (5' to 3') | UBE3A-ATS (% UTC) | SEQ ID NO |
|---|---|---|---|---|---|
| 617456 | 463905 | 463924 | CAACTGTTACCAAGACTTCA | 22 | 32 |
| 617457 | 465003 | 465022 | ATCTGCGAATAGAGGCCCTC | 22 | 33 |
| 617460 | 466539 | 466558 | TAGGTTGCATAAAGCCAGGC | 35 | 36 |
| 617461 | 466981 | 467000 | CACACATCTTGTTCCCTCAA | 36 | 37 |
| 617557 | 483977 | 483996 | ATCATGTGCATACCCAGGGT | 9 | 172 |
| 705110 | 229870# | 229889# | TCACTCATTTTGTTCAGCTT | 33 | 173 |
| 705112 | 232607# | 232626# | GTTTTCACTCATTTTGTTCA | 61 | 174 |
| 750513 | 220331 456700 | 220350 456719 | ACAATTATTCTCATCATCGA | 113 | 175 |
| 750514 | 220346 456715 | 220365 456734 | CCTCAGCATCCTCAGACAAT | 80 | 176 |
| 750515 | 220359 456728 | 220378 456747 | TCTGGAATGAGTCCCTCAGC | 73 | 177 |
| 750516 | 220371 456740 | 220390 456759 | CTCAGATTGACATCTGGAAT | 123 | 178 |
| 750517 | 229869# | 229888# | CACTCATTTTGTTCAGCTTT | 15 | 179 |
| 750518 | 232608# | 232627# | AGTTTTCACTCATTTTGTTC | 67 | 180 |
| 750519 | 349103# | 349122# | GTCATCACCTCTCTTCAGGA | 22 | 181 |
| 750520 | 349105# | 349124# | AAGTCATCACCTCTCTTCAG | 35 | 182 |
| 750521 | 349107# | 349126# | TTAAGTCATCACCTCTCTTC | 55 | 183 |
| 750522 | 349109# | 349128# | TTTTAAGTCATCACCTCTCT | 37 | 184 |
| 750523 | 349111# | 349130# | ATTTTTAAGTCATCACCTCT | 45 | 185 |
| 750524 | 349113# | 349132# | TGATTTTTAAGTCATCACCT | 25 | 186 |
| 750525 | 349115# | 349134# | CATGATTTTTAAGTCATCAC | 55 | 187 |
| 750526 | 349117# | 349136# | AGCATGATTTTTAAGTCATC | 65 | 188 |
| 750527 | 349119# | 349138# | TGAGCATGATTTTTAAGTCA | 46 | 189 |
| 750528 | 349121# | 349140# | ATTGAGCATGATTTTTAAGT | 56 | 190 |
| 750529 | 349123# | 349142# | CTATTGAGCATGATTTTTAA | 60 | 191 |
| 750530 | 349125# | 349144# | TCCTATTGAGCATGATTTTT | 56 | 192 |
| 750531 | 349127# | 349146# | AATCCTATTGAGCATGATTT | 41 | 193 |
| 750532 | 349129# | 349148# | GTAATCCTATTGAGCATGAT | 26 | 194 |
| 750533 | 349131# | 349150# | GCGTAATCCTATTGAGCATG | 34 | 195 |
| 750534 | 349133# | 349152# | CAGCGTAATCCTATTGAGCA | 63 | 196 |
| 750535 | 349135# | 349154# | CTCAGCGTAATCCTATTGAG | 50 | 197 |
| 750536 | 349137# | 349156# | GCCTCAGCGTAATCCTATTG | 71 | 198 |
| 750537 | 349139# | 349158# | GGGCCTCAGCGTAATCCTAT | 48 | 199 |
| 750538 | 349141# | 349160# | CTGGGCCTCAGCGTAATCCT | 28 | 200 |
| 750539 | 349143# | 349162# | GGCTGGGCCTCAGCGTAATC | 75 | 201 |
| 750540 | 355254# | 355273# | TAGGCTGGGCCTCAGCGTAA | 32 | 202 |

TABLE 4-continued

Reduction of UBE3A-ATS RNA by 5,000 nM 5-10-5 MOE gapmers with mixed PO/PS internucleoside linkages in vitro (35,000 cells/well)

| Compound Number | SEQ ID NO: 1 Start Site | SEQ ID NO: 1 Stop Site | Sequence (5' to 3') | UBE3A-ATS (% UTC) | SEQ ID NO |
|---|---|---|---|---|---|
| 750541 | 349147# | 349166# | CCTAGGCTGGGCCTCAGCGT | 98 | 203 |
| 750542 | 349149# | 349168# | CACCTAGGCTGGGCCTCAGC | 21 | 204 |
| 750543 | 349151# | 349170# | CTCACCTAGGCTGGGCCTCA | 55 | 205 |
| 750544 | 349153# | 349172# | TTCTCACCTAGGCTGGGCCT | 24 | 206 |
| 750545 | 349155# | 349174# | AATTCTCACCTAGGCTGGGC | 53 | 207 |
| 750546 | 349157# | 349176# | AAAATTCTCACCTAGGCTGG | 39 | 208 |
| 750547 | 349159# | 349178# | CCAAAATTCTCACCTAGGCT | 46 | 209 |
| 750548 | 349162# | 349181# | CTTCCAAAATTCTCACCTAG | 95 | 210 |
| 750549 | 349165# | 349184# | CCTCTTCCAAAATTCTCACC | 17 | 211 |
| 750550 | 349168# | 349187# | CATCCTCTTCCAAAATTCTC | 75 | 212 |
| 750551 | 349171# | 349190# | CAGCATCCTCTTCCAAAATT | 50 | 213 |
| 750552 | 349174# | 349193# | TCCCAGCATCCTCTTCCAAA | 70 | 214 |
| 750553 | 349177# | 349196# | GGATCCCAGCATCCTCTTCC | 53 | 215 |
| 750554 | 349346 409462 | 349365 409481 | GCCACCCACATGCCCTGCCC | 25 | 216 |
| 750555 | 349390# | 349409# | AGAGCTCACTGAAAGACACA | 63 | 217 |
| 750556 | 349392# | 349411# | GAAGAGCTCACTGAAAGACA | 85 | 218 |
| 750557 | 349442# | 349461# | GCAGGATCCACTCACCTATG | 27 | 219 |
| 750558 | 349957# | 349976# | CAGAGCTCAGCCTTGACCCA | 45 | 220 |
| 750559 | 350910# | 350929# | AGCTCAGTGCAGGAGACCAG | 56 | 221 |
| 750560 | 350914# | 350933# | CCACAGCTCAGTGCAGGAGA | 72 | 222 |
| 750561 | 350924# | 350943# | GATGTGCTCACCACAGCTCA | 115 | 223 |
| 750562 | 351544# | 351563# | GGAACCCTTTCCTGCCTGGA | 56 | 224 |
| 750563 | 353287# | 353306# | CAATATAAGGTTCTCATCAT | 42 | 225 |
| 750564 | 353293# | 353312# | TCAGGACAATATAAGGTTCT | 115 | 226 |
| 750565 | 353305# | 353324# | CATCACCTCTCTTCAGGACA | 37 | 227 |
| 750566 | 353356 407396 | 353375 407415 | TCTCACCTAGGCTAGGCCTC | 44 | 228 |
| 750567 | 353579# | 353598# | AGCTCACTGAAAGACACAAG | 49 | 229 |
| 750568 | 358746# | 358765# | AGGAAGGGCCTGAGCTTCAG | 34 | 230 |
| 750569 | 363914 384545 | 363933 384564 | CTCACCACACCTCAGTGCAG | 93 | 231 |
| 750570 | 364549# | 364568# | CTTTCCTGCCTGGACCACCA | 68 | 232 |
| 750571 | 366064 373449 | 366083 373468 | TTGGGCACCCTCCAGATGCC | 63 | 233 |
| 750572 | 366247 370104 386794 | 366266 370123 386813 | CACTCACCTATGCTGGTCAA | 72 | 234 |
| 750573 | 366487 407918 | 366506 407937 | TCAGCTGGGTGCTGCCCTGC | 117 | 235 |

TABLE 4-continued

Reduction of UBE3A-ATS RNA by 5,000 nM 5-10-5 MOE gapmers with mixed PO/PS internucleoside linkages in vitro (35,000 cells/well)

| Compound Number | SEQ ID NO: 1 Start Site | SEQ ID NO: 1 Stop Site | Sequence (5' to 3') | UBE3A-ATS (% UTC) | SEQ ID NO |
|---|---|---|---|---|---|
| 750574 | 366668 | 366687 | CCATTCAGGGCCATGGGTTT | 67 | 236 |
|  | 374053 | 374072 |  |  |  |
| 750575 | 391964 | 391983 | TCCCTGCACATGCATCCAGC | 97 | 237 |
|  | 393859 | 393878 |  |  |  |
|  | 403520 | 403539 |  |  |  |
| 750576 | 395822 | 395841 | ACTCCAGGGACCAAGAGCTC | 49 | 238 |
|  | 420812 | 420831 |  |  |  |
| 750577 | 397780 | 397799 | GAGACCCACTGAGATGGCCC | 26 | 239 |
|  | 415262 | 415281 |  |  |  |
| 750578 | 402885 | 402904 | ACCCCATGACCCTGGAGGTG | 63 | 240 |
|  | 410060 | 410079 |  |  |  |
| 750579 | 403932 | 403951 | ATGACCCCAGCAGGATGCAC | 57 | 241 |
|  | 424209 | 424228 |  |  |  |
| 750580 | 422678 | 422697 | TCACCCACCACTGTCCAGAG | 95 | 242 |
|  | 426410 | 426429 |  |  |  |
| 750581 | 422778 | 422797 | GTACCACTGAGATGGCCCAT | 68 | 243 |
|  | 426510 | 426529 |  |  |  |
| 750582 | 423273 | 423292 | AATGCAGACCTGGCAGTCGC | 50 | 244 |
|  | 430180 | 430199 |  |  |  |

TABLE 4b

SEQ ID NO: 1 start sites for modified oligonucleotides complementary to repeat regions

| Compound Number | # of comp. sites within SEQ ID NO: 1 | SEQ ID NO: 1 start sites | SEQ ID NO: |
|---|---|---|---|
| 705110 | 20 | 229870, 232603, 235253, 237932, 240726, 243420, 246181, 248825, 251500, 258532, 259677, 261158, 261978, 263775, 264917, 266052, 267194, 268313, 270176, 272427 | 173 |
| 705112 | 16 | 232607, 237936, 243424, 252518, 254323, 258536, 259681, 261162, 261982, 263779, 264921, 266056, 267198, 268317, 270180, 272431 | 174 |
| 750517 | 21 | 229869, 232602, 235252, 237931, 240725, 243419, 246180, 248824, 251499, 257447, 258531, 259676, 261157, 261977, 263774, 264916, 266051, 267193, 268312, 270175, 272426 | 179 |
| 750518 | 16 | 232608, 237937, 243425, 252519, 254324, 258537, 259682, 261163, 261983, 263780, 264922, 266057, 267199, 268318, 270181, 272432 | 180 |
| 750519 | 20 | 349103, 353307, 357118, 364011, 367794, 369796, 371701, 377828, 379703, 381607, 382737, 384642, 388298, 393921, 396997, 401626, 414465, 420126, 421994, 423858, 427578 | 181 |
| 750520 | 30 | 349105, 353309, 355214, 357120, 358879, 364013, 365917, 367796, 369798, 371703, 373302, 375957, 377830, 379705, 381609, 382739, 384644, 386464, 388300, 393923, 396999, 400729, 401628, 410769, 414467, 420128, 421996, 423860, 425727, 427580 | 182 |
| 750521 | 33 | 349107, 351019, 353311, 355216, 357122, 358881, 364015, 365919, 367798, 369800, 371705, 373304, 375959, 377832, 379707, 381611, 382741, 384646, 386466, 388302, 390180, 393925, 397001, 400731, 401630, 410771, 412631, 414469, 420130, 421998, 423862, 425729, 427582 | 183 |
| 750522 | 33 | 349109, 351021, 353313, 355218, 357124, 358883, 364017, 365921, 367800, 369802, 371707, 373306, 375961, 377834, 379709, 381613, 382743, 384648, 386468, 388304, 390182, 393927, 397003, 400733, 401632, 410773, 412633, 414471, 420132, 422000, 423864, 425731, 427584 | 184 |
| 750523 | 31 | 349111, 351023, 353315, 355220, 357126, 358885, 364019, 365923, 367802, 369804, 371709, 373308, 375963, 377836, 379711, 381615, 382745, 384650, 386470, 388306, 393929, 397005, 401634, 410775, 412635, 414473, 420134, 422002, 423866, 425733, 427586 | 185 |
| 750524 | 32 | 349113, 351025, 353317, 355222, 357128, 358887, 364021, 365925, 367804, 369806, 371711, 373310, 375965, 377838, 379713, 381617, 382747, 384652, 386472, 388308, 393931, 397007, 401636, 405499, 410777, 412637, 414475, 420136, 422004, 423868, 425735, 427588 | 186 |

TABLE 4b-continued

SEQ ID NO: 1 start sites for modified oligonucleotides complementary to repeat regions

| Compound Number | # of comp. sites within SEQ ID NO: 1 | SEQ ID NO: 1 start sites | SEQ ID NO: |
|---|---|---|---|
| 750525 | 30 | 349115, 351027, 353319, 355224, 357130, 358889, 364023, 365927, 367806, 369808, 371713, 373312, 375967, 377840, 384654, 386474, 388310, 393933, 397009, 401638, 405501, 410779, 412639, 414477, 420138, 422006, 423870, 425737, 427590, 429251 | 187 |
| 750526 | 31 | 349117, 351029, 353321, 355226, 357132, 358891, 362700, 364025, 365929, 367808, 369810, 371715, 373314, 375969, 377842, 384656, 386476, 388312, 397011, 401640, 405503, 410781, 412641, 414479, 418232, 420140, 422008, 423872, 425739, 427592, 429253 | 188 |
| 750527 | 31 | 349119, 351031, 355228, 357134, 358893, 362702, 364027, 365931, 367810, 369812, 371717, 373316, 375971, 377844, 384658, 386478, 388314, 392044, 397013, 401642, 405505, 410783, 412643, 414481, 418234, 420142, 422010, 423874, 425741, 427594, 429255 | 189 |
| 750528 | 32 | 349121, 351033, 355230, 357136, 358895, 360780, 362704, 364029, 365933, 367812, 369814, 371719, 373318, 375973, 377846, 384660, 386480, 388316, 392046, 397015, 401644, 405507, 410785, 412645, 414483, 418236, 420144, 422012, 423876, 425743, 427596, 429257 | 190 |
| 750529 | 32 | 349123, 351035, 355232, 357138, 358897, 362706, 364031, 365935, 367814, 369816, 371721, 373320, 375975, 377848, 384662, 386482, 388318, 392048, 397017, 401646, 403603, 405509, 410787, 412647, 414485, 418238, 420146, 422014, 423878, 425745, 427598, 429259 | 191 |
| 750530 | 33 | 349125, 349125, 351037, 355234, 357140, 358899, 362708, 364033, 365937, 367816, 369818, 371723, 373322, 375977, 377850, 384664, 386484, 388320, 392050, 397019, 401648, 403605, 405511, 410789, 412649, 414487, 418240, 420148, 422016, 423880, 425747, 427600, 429261 | 192 |
| 750531 | 32 | 349127, 351039, 355236, 357142, 358901, 362710, 364035, 365939, 367818, 369820, 371725, 373324, 375979, 377852, 384666, 386486, 388322, 392052, 397021, 401650, 403607, 405513, 410791, 412651, 414489, 418242, 420150, 422018, 423882, 425749, 427602, 429263 | 193 |
| 750532 | 31 | 349129, 355238, 357144, 358903, 362712, 364037, 365941, 367820, 369822, 371727, 373326, 375981, 377854, 386488, 388324, 392054, 397023, 398903, 401652, 403609, 405515, 410793, 412653, 414491, 418244, 420152, 422020, 423884, 425751, 427604, 429265 | 194 |
| 750533 | 28 | 349131, 355240, 357146, 358905, 362714, 364039, 365943, 367822, 369824, 371729, 373328, 375983, 377856, 386490, 388326, 392056, 397025, 401654, 403611, 410795, 414493, 418246, 420154, 422022, 423886, 425753, 427606, 429267 | 195 |
| 750534 | 29 | 349133, 355242, 357148, 358907, 362716, 364041, 365945, 367824, 369826, 371731, 373330, 375985, 377858, 386492, 388328, 392058, 397027, 401656, 403613, 409248, 410797, 414495, 418248, 420156, 422024, 423888, 425755, 427608, 429269 | 196 |
| 750535 | 29 | 349135, 355244, 357150, 358909, 362718, 364043, 365947, 367826, 369828, 371733, 373332, 375987, 377860, 386494, 388330, 392060, 397029, 401658, 403615, 409250, 410799, 414497, 418250, 420158, 422026, 423890, 425757, 427610, 429271 | 197 |
| 750536 | 30 | 349137, 355246, 357152, 358911, 362720, 364045, 365949, 367828, 369830, 371735, 373334, 375989, 377862, 386496, 392062, 393955, 397031, 401660, 403617, 407381, 409252, 410801, 414499, 418252, 420160, 422028, 423892, 425759, 427612, 429273 | 198 |
| 750537 | 30 | 349139, 355248, 357154, 358913, 360801, 362722, 364047, 365951, 367830, 369832, 371737, 373336, 375991, 377864, 386498, 392064, 393957, 397033, 401662, 403619, 409254, 410803, 414501, 418254, 420162, 422030, 423894, 425761, 427614, 429275 | 199 |
| 750538 | 25 | 349141, 355250, 357156, 358915, 360803, 362724, 365953, 367832, 369834, 371739, 373338, 375993, 377866, 392066, 393959, 397035, 401664, 403621, 410805, 418256, 420164, 422032, 425763, 427616, 429277 | 200 |
| 750539 | 22 | 349143, 355252, 357158, 358917, 362726, 365955, 369836, 373340, 375995, 377868, 392068, 393961, 397037, 401666, 403623, 410807, 418258, 420166, 422034, 425765, 429279, 448197 | 201 |
| 750540 | 20 | 349145, 355254, 358919, 362728, 365957, 369838, 373342, 375997, 377870, 392070, 393963, 401668, 403625, 410809, 418260, 420168, 422036, 425767, 429281, 448199 | 202 |
| 750541 | 18 | 349147, 355256, 358921, 362730, 365959, 369840, 373344, 375999, 377872, 393965, 401670, 410811, 418262, 420170, 422038, 425769, 429283, 448201 | 203 |
| 750542 | 17 | 349149, 351061, 355258, 358923, 362732, 365961, 369842, 373346, 376001, 377874, 393967, 410813, 418264, 420172, 422040, 425771, 429285 | 204 |
| 750543 | 16 | 349151, 351063, 355260, 358925, 362734, 365963, 369844, 373348, 376003, 377876, 393969, 418266, 420174, 422042, 425773, 429287 | 205 |
| 750544 | 15 | 349153, 351065, 355262, 358927, 362736, 365965, 369846, 373350, 376005, 377878, 418268, 420176, 422044, 425775, 429289 | 206 |
| 750545 | 14 | 349155, 351067, 355264, 358929, 362738, 365967, 369848, 373352, 376007, 377880, 418270, 420178, 425777, 429291 | 207 |
| 750546 | 13 | 349157, 351069, 355266, 358931, 362740, 365969, 369850, 373354, 376009, 418272, 420180, 425779, 429293 | 208 |

TABLE 4b-continued

SEQ ID NO: 1 start sites for modified oligonucleotides complementary to repeat regions

| Compound Number | # of comp. sites within SEQ ID NO: 1 | SEQ ID NO: 1 start sites | SEQ ID NO: |
|---|---|---|---|
| 750547 | 14 | 349159, 351071, 355268, 358933, 362742, 365971, 369852, 373356, 376011, 407403, 418274, 420182, 425781, 429295 | 209 |
| 750548 | 17 | 349162, 351074, 355271, 358936, 362745, 365974, 369855, 373359, 376014, 407406, 412686, 416425, 418277, 420185, 425784, 427637, 429298 | 210 |
| 750549 | 12 | 349165, 351077, 357180, 358939, 362748, 365977, 373362, 376017, 412689, 418280, 425787, 429301 | 211 |
| 750550 | 9 | 349168, 351080, 357183, 358942, 365980, 373365, 376020, 412692, 425790 | 212 |
| 750551 | 11 | 349171, 351083, 357186, 358945, 365983, 373368, 376023, 381675, 405557, 412695, 425793 | 213 |
| 750552 | 14 | 349174, 351086, 358948, 360836, 365986, 371772, 373371, 376026, 377898, 381678, 393992, 412698, 422065, 425796 | 214 |
| 750553 | 10 | 349177, 351089, 358951, 371775, 377901, 381681, 384716, 412701, 422068, 425799 | 215 |
| 750555 | 23 | 349390, 351292, 353581, 355499, 361054, 364302, 368083, 370059, 371989, 373589, 378120, 379994, 383026, 388586, 390466, 401917, 403871, 409508, 411053, 412917, 414751, 420414, 429518 | 217 |
| 750556 | 24 | 349392, 351294, 353583, 355501, 361056, 364304, 368085, 370061, 371991, 373591, 376253, 378122, 383028, 388588, 390468, 401919, 403873, 409510, 411055, 412919, 420416, 422284, 426016, 429520 | 218 |
| 750557 | 13 | 349442, 353633, 366255, 373640, 378173, 390519, 397322, 401968, 407684, 409560, 414803, 420466, 429569 | 219 |
| 750558 | 7 | 349957, 359696, 374917, 376821, 383615, 389153, 411626 | 220 |
| 750559 | 12 | 350910, 358772, 365811, 373197, 375845, 403478, 407243, 410663, 423753, 425620, 427479, 429146 | 221 |
| 750560 | 12 | 350914, 358776, 365815, 373201, 375849, 390074, 403482, 410667, 423757, 425624, 427483, 429150 | 222 |
| 750561 | 10 | 350924, 358786, 360674, 365825, 375859, 390084, 401536, 409127, 425634, 427493 | 223 |
| 750562 | 10 | 351544, 353840, 361305, 363233, 397528, 399421, 413175, 415009, 418768, 424402 | 224 |
| 750563 | 20 | 353287, 357098, 358857, 363991, 365896, 367774, 369776, 379683, 381587, 382717, 384622, 388278, 398857, 401606, 403563, 414445, 416346, 425705, 427558, 429219 | 225 |
| 750564 | 20 | 353293, 357104, 360748, 363997, 367780, 369782, 379689, 381593, 382723, 384628, 388284, 393907, 396983, 398863, 401612, 405475, 414451, 416352, 427564, 429225 | 226 |
| 750565 | 17 | 353305, 357116, 364009, 367792, 369794, 379701, 381605, 382735, 384640, 388296, 393919, 396995, 401624, 414463, 420124, 423856, 427576 | 227 |
| 750567 | 12 | 353579, 361052, 370057, 378118, 388584, 390464, 401915, 409506, 412915, 414749, 420412, 429516 | 229 |
| 750568 | 11 | 358746, 362555, 365785, 369656, 375819, 381477, 382607, 386333, 390044, 416238, 421864 | 230 |
| 750570 | 11 | 364549, 385176, 392568, 397522, 399415, 404124, 407883, 413169, 415003, 418762, 428112 | 232 |

TABLE 5

Reduction of UBE3A-ATS RNA by 7,000 nM 5-10-5 MOE gapmers with mixed PO/PS internucleoside linkages in vitro (35,000 cells/well)

| Compound Number | SEQ ID NO: 1 Start Site | SEQ ID NO: 1 Stop Site | Sequence (5' to 3') | UBE3A-ATS (% UTC) | SEQ ID NO |
|---|---|---|---|---|---|
| 617456 | 463905 | 463924 | CAACTGTTACCAAGACTTCA | 40 | 32 |
| 617457 | 465003 | 465022 | ATCTGCGAATAGAGGCCCTC | 30 | 33 |
| 617460 | 466539 | 466558 | TAGGTTGCATAAAGCCAGGC | 40 | 36 |
| 617461 | 466981 | 467000 | CACACATCTTGTTCCCTCAA | 41 | 37 |
| 617557 | 483977 | 483996 | ATCATGTGCATACCCAGGGT | 26 | 172 |
| 750326 | 504100 | 504119 | CTTCAACTAACAGTATCTTA | 20 | 245 |
| 750327 | 504103 | 504122 | AGTCTTCAACTAACAGTATC | 51 | 246 |
| 750328 | 504126 | 504145 | CTATTTCATTAAGTCACCCC | 53 | 247 |
| 750329 | 504179 | 504198 | GGACAGCTGTGTGGAGGGAT | 26 | 248 |

TABLE 5-continued

Reduction of UBE3A-ATS RNA by 7,000 nM 5-10-5 MOE gapmers with mixed PO/PS internucleoside linkages in vitro (35,000 cells/well)

| Compound Number | SEQ ID NO: 1 Start Site | SEQ ID NO: 1 Stop Site | Sequence (5' to 3') | UBE3A-ATS (% UTC) | SEQ ID NO |
|---|---|---|---|---|---|
| 750330 | 504218 | 504237 | ACCACCAGGGAGACCAGCCT | 68 | 249 |
| 750331 | 504228 | 504247 | CAGCCTTTCTACCACCAGGG | 55 | 250 |
| 750332 | 504229 | 504248 | TCAGCCTTTCTACCACCAGG | 32 | 251 |
| 750333 | 504334 | 504353 | ACAGAGTGTTTACTGTGAGC | 29 | 252 |
| 750334 | 504503 | 504522 | TCCATGGAATGGCTGTCATG | 39 | 253 |
| 750335 | 504731 | 504750 | TTCCTTCAGAGTTATTTCTT | 73 | 254 |
| 750336 | 504740 | 504759 | TTATTCTCCTTCCTTCAGAG | 70 | 255 |
| 750337 | 504741 | 504760 | GTTATTCTCCTTCCTTCAGA | 41 | 256 |
| 750338 | 504817 | 504836 | GAAGTAGTCCTGCCCTTTCC | 60 | 257 |
| 750339 | 504923 | 504942 | ATATCCTTTCCTCTCCTACT | 78 | 258 |
| 750340 | 504958 | 504977 | GACTGATGGTTACCCATACA | 40 | 259 |
| 750341 | 504987 | 505006 | CATTTAACAACTATTATCTT | 27 | 260 |
| 750342 | 505003 | 505022 | TCATTAAATAGCTAACCATT | 91 | 261 |
| 750343 | 505043 | 505062 | CCACTTTGCAACTCAAGATT | 31 | 262 |
| 750344 | 505046 | 505065 | CAGCCACTTTGCAACTCAAG | 20 | 263 |
| 750345 | 505051 | 505070 | GACTCCAGCCACTTTGCAAC | 62 | 264 |
| 750346 | 505073 | 505092 | CCAGAAATTTAGTCTGTTGT | 59 | 265 |
| 750347 | 505096 | 505115 | CATAAGCTGCTGGATTTGTT | 51 | 266 |
| 750348 | 505241 | 505260 | GAAGAGAACGAGGATATAAA | 35 | 267 |
| 750349 | 505306 | 505325 | GTGATATATTAGAACTGTAT | 28 | 268 |
| 750350 | 505443 | 505462 | AGAGGATTTAGAGTTAAAAT | 22 | 269 |
| 750351 | 505569 | 505588 | ACTGAAAGGTCTGTATGTTT | 73 | 270 |
| 750352 | 505656 | 505675 | CAGGCCTAGCTTCCACCTAA | 108 | 271 |
| 750353 | 505837 | 505856 | TCTGTCAAAGACCTGTGAGG | 56 | 272 |
| 750354 | 505922 | 505941 | TCTGCTTGTGGTTCTTCCCT | 71 | 273 |
| 750355 | 505985 | 506004 | CAAATATGGAATAGCACTTG | 54 | 274 |
| 750356 | 506040 | 506059 | GTTGAGAACGGTATTGAGTA | 56 | 275 |
| 750357 | 506052 | 506071 | CTCTTGTTTTCAGTTGAGAA | 42 | 276 |
| 750358 | 506097 | 506116 | ATTTCTCCATGGACTCCAGA | 47 | 277 |
| 750359 | 506109 | 506128 | CATTGGCTTCATATTTCTCC | 11 | 278 |
| 750360 | 506306 | 506325 | TATTGCCTTCACTGCTGCCT | 9 | 279 |
| 750361 | 506518 | 506537 | ACTGACTTGCTCTGCCTACT | 71 | 280 |
| 750362 | 506617 | 506636 | GAGAAGTCTCTCATGGCACC | 40 | 281 |
| 750363 | 506731 | 506750 | GGAGTGCTCCACACTTCTGT | 27 | 282 |
| 750364 | 506776 | 506795 | CTCCAGGTTGTGGAGGTTGT | 75 | 283 |
| 750365 | 506783 | 506802 | GTATATACTCCAGGTTGTGG | 23 | 284 |

TABLE 5-continued

Reduction of UBE3A-ATS RNA by 7,000 nM 5-10-5 MOE gapmers with mixed PO/PS internucleoside linkages in vitro (35,000 cells/well)

| Compound Number | SEQ ID NO: 1 Start Site | SEQ ID NO: 1 Stop Site | Sequence (5' to 3') | UBE3A-ATS (% UTC) | SEQ ID NO |
|---|---|---|---|---|---|
| 750366 | 506881 | 506900 | ACTTCTCATTCTCTCCACCA | 17 | 285 |
| 750367 | 507189 | 507208 | AAAGCATTTTCTACCAGAGC | 45 | 286 |
| 750368 | 507198 | 507217 | TAGACAAGGAAAGCATTTTC | 54 | 287 |
| 750369 | 507312 | 507331 | CACCTGCCCTGCTTTTGCTT | 41 | 288 |
| 750370 | 507324 | 507343 | TGGTCCTAGCTTCACCTGCC | 89 | 289 |
| 750371 | 507357 | 507376 | AGATCCAACCTGTGTGGAAA | 61 | 290 |
| 750372 | 507534 | 507553 | AGAAATTAGAGCCAGGTTCC | 36 | 291 |
| 750373 | 507635 | 507654 | TCCCCCCAGAAGGCTTGACT | 71 | 292 |
| 750374 | 507755 | 507774 | TCGCTGGCCATTTCATATAT | 44 | 293 |
| 750375 | 507978 | 507997 | AAAACATGTTAACTGTTATC | 40 | 294 |
| 750376 | 508159 | 508178 | TTAGCCATGTGCTTTGTGAC | 68 | 295 |
| 750377 | 508208 | 508227 | TCCCTTCTGTCATCTGATCT | 59 | 296 |
| 750378 | 508218 | 508237 | AAGGTAGTTCTCCCTTCTGT | 93 | 297 |
| 750379 | 508426 | 508445 | TTCCATTGCACTCCTTTCTA | 113 | 298 |
| 750380 | 508530 | 508549 | TAAAAGGAAAACCCACTTGT | 72 | 299 |
| 750381 | 508700 | 508719 | TACAGAAATTACCAGTAAAG | 38 | 300 |
| 750382 | 508710 | 508729 | TCCAGATTTCTACAGAAATT | 102 | 301 |
| 750383 | 503980<br>508746 | 503999<br>508765 | TCACTGCACACTGTACAGGA | 78 | 302 |
| 750384 | 508890 | 508909 | TGCCTAGTTCCCTCCTGAAA | 98 | 303 |
| 750385 | 508908 | 508927 | TTATGTTTACTTCATGACTG | 91 | 304 |
| 750386 | 508945 | 508964 | CTTCATTATTCTCTAGTGCC | 14 | 305 |
| 750387 | 509013 | 509032 | CTATTCCCCTTCAACATGTG | 44 | 306 |
| 750388 | 509060 | 509079 | CATACCCAACATGCTTGCAT | 44 | 307 |
| 750389 | 509079 | 509098 | AATGCATTACCCTACAATGC | 105 | 308 |
| 750390 | 509127 | 509146 | CTCATCACAACTGGGTGGTA | 76 | 309 |
| 750391 | 509134 | 509153 | ATCCCAGCTCATCACAACTG | 88 | 310 |
| 750392 | 509167 | 509186 | TCCAAGTGCTTCAAGCTGAG | 100 | 311 |
| 750393 | 509189 | 509208 | CACCCACAGCAGGCAGATAA | 58 | 312 |
| 750394 | 509208 | 509227 | TACCTTGCTCCAAAATAATC | 37 | 313 |
| 750395 | 509230 | 509249 | CTGTTTCTTGAGGCAAATGA | 54 | 314 |
| 750396 | 509787 | 509806 | CTTTTCTCAATGTCAACTCT | 48 | 315 |
| 750397 | 510028 | 510047 | AGAGTTATACACGGAACCCA | 71 | 316 |

TABLE 6

Reduction of UBE3A-ATS RNA by 8,000 nM 5-10-5 MOE gapmers with mixed PO/PS internucleoside linkages in vitro (40,000 cells/well)

| Compound Number | SEQ ID NO: 1 Start Site | SEQ ID NO: 1 Stop Site | Sequence (5' to 3') | UBE3A-ATS (% UTC) | SEQ ID NO |
|---|---|---|---|---|---|
| 617456 | 463905 | 463924 | CAACTGTTACCAAGACTTCA | 26 | 32 |
| 617457 | 465003 | 465022 | ATCTGCGAATAGAGGCCCTC | 46 | 33 |
| 617460 | 466539 | 466558 | TAGGTTGCATAAAGCCAGGC | 8 | 36 |
| 617461 | 466981 | 467000 | CACACATCTTGTTCCCTCAA | 21 | 37 |
| 617557 | 483977 | 483996 | ATCATGTGCATACCCAGGGT | 23 | 172 |
| 749968 | 465163 | 465182 | TTCTAGGGCTCCAGTTTATG | 86 | 317 |
| 749969 | 465238 | 465257 | TGGTCATCTCGGGTATATAA | 20 | 318 |
| 749970 | 465341 | 465360 | CTTACTATCTTCAAGAATTC | 68 | 319 |
| 749971 | 465346 | 465365 | TTTTTCTTACTATCTTCAAG | 56 | 320 |
| 749972 | 465394 | 465413 | AGTCAATTGTCAGACTTATT | 37 | 321 |
| 749973 | 465587 | 465606 | AAGGAGTTCCTTTAGCATTT | 27 | 322 |
| 749974 | 465594 | 465613 | CAGACCGAAGGAGTTCCTTT | 50 | 323 |
| 749975 | 465612 | 465631 | TCCAGTGCCTTTCTATTTCA | 33 | 324 |
| 749976 | 465686 | 465705 | ACTTTGTTTTAAACTTACAC | 46 | 325 |
| 749977 | 465765 | 465784 | CATCAACACAAGTTTATAAT | 47 | 326 |
| 749978 | 465892 | 465911 | AACTCCCACAAGGTACTCTT | 32 | 327 |
| 749979 | 465906 | 465925 | ACTGTCAACTCCTGAACTCC | 54 | 328 |
| 749980 | 465956 | 465975 | CAATGAATCTATTCTTAGAT | 122 | 329 |
| 749981 | 465978 | 465997 | GTGAAACTGTTTATACCCTT | 25 | 330 |
| 749982 | 465996 | 466015 | GTTGGTGATGCAGGTAAAGT | 24 | 331 |
| 749983 | 466024 | 466043 | TTGTTACTGAGCTGTGCCAC | 48 | 332 |
| 749984 | 466119 | 466138 | AAGTGGATCTCTTGGGCAGG | 22 | 333 |
| 749985 | 466182 | 466201 | TTTACCCTCTCCCAACCACT | 51 | 334 |
| 749986 | 466217 | 466236 | GGCTGCTGTTTGAGTCCCCA | 40 | 335 |
| 749987 | 466220 | 466239 | ATGGGCTGCTGTTTGAGTCC | 58 | 336 |
| 749988 | 466221 | 466240 | TATGGGCTGCTGTTTGAGTC | 55 | 337 |
| 749989 | 466529 | 466548 | AAAGCCAGGCCAGGTGCTGA | 64 | 338 |
| 749990 | 466532 | 466551 | CATAAAGCCAGGCCAGGTGC | 30 | 339 |
| 749991 | 466534 | 466553 | TGCATAAAGCCAGGCCAGGT | 20 | 340 |
| 749992 | 466537 | 466556 | GGTTGCATAAAGCCAGGCCA | 36 | 341 |
| 749993 | 466539 | 466558 | TAGGTTGCATAAAGCCAGGC | 46 | 36 |
| 749994 | 466541 | 466560 | TCTAGGTTGCATAAAGCCAG | 52 | 342 |
| 749995 | 466544 | 466563 | TTCTCTAGGTTGCATAAAGC | 33 | 343 |
| 749996 | 466546 | 466565 | CCTTCTCTAGGTTGCATAAA | 28 | 344 |
| 749997 | 466549 | 466568 | TCACCTTCTCTAGGTTGCAT | 34 | 345 |
| 749998 | 466551 | 466570 | TATCACCTTCTCTAGGTTGC | 44 | 346 |
| 749999 | 466701 | 466720 | AAATAACTGGATCTCATAAC | 55 | 114 |

TABLE 6-continued

Reduction of UBE3A-ATS RNA by 8,000 nM 5-10-5 MOE gapmers with mixed PO/PS internucleoside linkages in vitro (40,000 cells/well)

| Compound Number | SEQ ID NO: 1 Start Site | SEQ ID NO: 1 Stop Site | Sequence (5' to 3') | UBE3A-ATS (% UTC) | SEQ ID NO |
|---|---|---|---|---|---|
| 750000 | 466979 | 466998 | CACATCTTGTTCCCTCAAGG | 26 | 347 |
| 750001 | 466981 | 467000 | CACACATCTTGTTCCCTCAA | 26 | 37 |
| 750002 | 466983 | 467002 | TTCACACATCTTGTTCCCTC | 26 | 348 |
| 750003 | 466986 | 467005 | TGCTTCACACATCTTGTTCC | 43 | 349 |
| 750004 | 466988 | 467007 | CCTGCTTCACACATCTTGTT | 49 | 350 |
| 750005 | 466991 | 467010 | GAACCTGCTTCACACATCTT | 36 | 351 |
| 750006 | 467049 | 467068 | CTTTCATCAGTTAGTCAGGT | 23 | 352 |
| 750007 | 467200 | 467219 | GGAGTTGGTTATTGGAAAAT | 48 | 353 |
| 750008 | 467289 | 467308 | TCTATTGGTGTTCCTTTTAG | 48 | 354 |
| 750009 | 467296 | 467315 | AGAGTAGTCTATTGGTGTTC | 22 | 355 |
| 750010 | 467363 | 467382 | CTTTTAAGATAATTTTTCTC | 90 | 356 |
| 750011 | 467417 | 467436 | TACGCTCCTTCATTTCATGC | 55 | 357 |
| 750012 | 467506 | 467525 | TTTTTAATCCTCTGATGAAT | 102 | 358 |
| 750013 | 467508 | 467527 | TTTTTTTAATCCTCTGATGA | 62 | 38 |
| 750014 | 467604 | 467623 | CTCTCTTCTCCTTTATGACT | 41 | 359 |
| 750015 | 467628 | 467647 | CTTAAATAAGTTTTCTACCC | 42 | 360 |
| 750016 | 467639 | 467658 | AGCCATTATTTCTTAAATAA | 56 | 361 |
| 750017 | 467669 | 467688 | CATATCTTTTCCTAGATTTG | 110 | 362 |
| 750018 | 467813 | 467832 | AGAATCCTGTCTCCCTCTTA | 34 | 363 |
| 750019 | 467916 | 467935 | TGAGTCTCTTTTCTTTCGGT | 41 | 364 |
| 750020 | 467919 | 467938 | TGATGAGTCTCTTTTCTTTC | 35 | 365 |
| 750021 | 467921 | 467940 | TGTGATGAGTCTCTTTTCTT | 30 | 366 |
| 750022 | 467962 | 467981 | TACTGAGAAATCTCTTGAAT | 77 | 367 |
| 750023 | 468277 | 468296 | TAAAATTATTTATACACCAT | 73 | 368 |
| 750024 | 468359 | 468378 | TTTATACTGTAGTATGCATT | 53 | 369 |
| 750025 | 468410 | 468429 | TTACTTCCCTACCCTTGCAT | 75 | 370 |
| 750026 | 468413 | 468432 | CTTTTACTTCCCTACCCTTG | 67 | 371 |
| 750027 | 468464 | 468483 | ATTTATTTTAAGCTGATAAC | 52 | 372 |
| 750028 | 468733 | 468752 | AAATCCATTTGTCCAGTCTG | 14 | 373 |
| 750029 | 468888 | 468907 | TATCTGCATGCAATATCTTT | 70 | 374 |
| 750030 | 468924 | 468943 | CTGTAAGTATAGATGCCTCT | 15 | 375 |
| 750031 | 468968 | 468987 | TTAGCCTTTTGATATAGTTT | 25 | 376 |
| 750032 | 468988 | 469007 | GCTTCACCATTTGACCTTC | 19 | 377 |
| 750033 | 469140 | 469159 | TTTTGAAAGGGAGGCACTGA | 27 | 378 |
| 750034 | 469604 | 469623 | TGAGGTGTAATGTTGTTTAT | 32 | 379 |
| 750035 | 469717 | 469736 | TAATAGTCTCTATTGTTTTT | 50 | 380 |

TABLE 6-continued

Reduction of UBE3A-ATS RNA by 8,000 nM 5-10-5 MOE gapmers with mixed PO/PS internucleoside linkages in vitro (40,000 cells/well)

| Compound Number | SEQ ID NO: 1 Start Site | SEQ ID NO: 1 Stop Site | Sequence (5' to 3') | UBE3A-ATS (% UTC) | SEQ ID NO |
|---|---|---|---|---|---|
| 750036 | 469884 | 469903 | CAAGTTAACTAATATGTTGG | 71 | 381 |
| 750037 | 469985 | 470004 | TATTGATTCAATTCCCTTAT | 23 | 382 |
| 750038 | 469988 | 470007 | GAATATTGATTCAATTCCCT | 37 | 383 |
| 750039 | 470062 | 470081 | AATTTTTTTAAATGGTTGGC | 51 | 384 |

TABLE 7

Reduction of UBE3A-ATS RNA by 8,000 nM 5-10-5 MOE gapmers with mixed PO/PS internucleoside linkages in vitro (40,000 cells/well)

| Compound Number | SEQ ID NO: 1 Start Site | SEQ ID NO: 1 Stop Site | Sequence (5' to 3') | UBE3A-ATS (% UTC) | SEQ ID NO |
|---|---|---|---|---|---|
| 617456 | 463905 | 463924 | CAACTGTTACCAAGACTTCA | 18 | 32 |
| 617457 | 465003 | 465022 | ATCTGCGAATAGAGGCCCTC | 36 | 33 |
| 617460 | 466539 | 466558 | TAGGTTGCATAAAGCCAGGC | 12 | 36 |
| 617461 | 466981 | 467000 | CACACATCTTGTTCCCTCAA | 16 | 37 |
| 617557 | 483977 | 483996 | ATCATGTGCATACCCAGGGT | 27 | 172 |
| 750182 | 488205 | 488224 | AACAGAGAATTGTATATCCA | 43 | 385 |
| 750183 | 488322 | 488341 | ACATGAGATCTTTAATAAGA | 73 | 386 |
| 750184 | 488343 | 488362 | CAAGAGAGAAGCCACTCATG | 64 | 387 |
| 750185 | 488685 | 488704 | AGCAGATTTGAGCTGGAAGA | 42 | 388 |
| 750186 | 488928 | 488947 | AACTGGCAGAAAATATCTCT | 36 | 389 |
| 750187 | 488941 | 488960 | AAAGAAGAACATAAACTGGC | 70 | 390 |
| 750188 | 489021 | 489040 | GTTGGCTCTATTTTCAAATG | 33 | 391 |
| 750189 | 489449 | 489468 | CTGTTTAGGCTGGACACTGT | 90 | 392 |
| 750190 | 489478 | 489497 | ATTCAGGAAATTAAAGCATT | 60 | 393 |
| 750191 | 489698 | 489717 | AGCAGAACAGACCTTATTTG | 41 | 394 |
| 750192 | 489712 | 489731 | CCTTCAACCAGAGGAGCAGA | 44 | 395 |
| 750193 | 489756 | 489775 | GATCTTGGTTTGTAGAAGGT | 35 | 396 |
| 750194 | 489824 | 489843 | TTCAAAATGGTAGAAAATTG | 64 | 397 |
| 750195 | 489873 | 489892 | TGAAAGGCCTACAGCAACCA | 46 | 398 |
| 750196 | 489893 | 489912 | ATGGGAGCTCTGGAAAACAG | 27 | 399 |
| 750197 | 490070 | 490089 | TTCTGAGTATATGTGAAACA | 39 | 400 |
| 750198 | 492874 | 492893 | ATAAGGAGATTAATTTAAGA | 86 | 401 |
| 750199 | 493278 | 493297 | GAATCAAAGAAAGAAGGAAT | 47 | 402 |
| 750200 | 493440 | 493459 | GCTGTAATAATAATCATATT | 41 | 403 |
| 750201 | 493678 | 493697 | AGAATTCTTCCCTACAGGTT | 51 | 404 |
| 750202 | 493831 | 493850 | CAGTAATTAATGTTCTTATA | 37 | 405 |
| 750203 | 493839 | 493858 | CCCCAATTCAGTAATTAATG | 39 | 406 |

TABLE 7-continued

Reduction of UBE3A-ATS RNA by 8,000 nM 5-10-5 MOE gapmers with mixed PO/PS internucleoside linkages in vitro (40,000 cells/well)

| Compound Number | SEQ ID NO: 1 Start Site | SEQ ID NO: 1 Stop Site | Sequence (5' to 3') | UBE3A-ATS (% UTC) | SEQ ID NO |
|---|---|---|---|---|---|
| 750204 | 493841 | 493860 | GGCCCCAATTCAGTAATTAA | 56 | 407 |
| 750205 | 493882 | 493901 | ATGTAACCTATTCAAGATGA | 47 | 408 |
| 750206 | 493908 | 493927 | TTATTTGGAAGAAGAATCTT | 98 | 409 |
| 750207 | 494002 | 494021 | TATAAATACTTTTTATGGG | 101 | 410 |
| 750208 | 494398 | 494417 | GACTGTGATAAAGATGTATA | 84 | 411 |
| 750209 | 494443 | 494462 | TAAGGGTCATGTACTATACA | 33 | 412 |
| 750210 | 494494 | 494513 | GTGTGTGCAATAGCCTAAAT | 27 | 413 |
| 750211 | 494554 | 494573 | CAGAAGCAAAGATAGCAGC | 53 | 414 |
| 750212 | 494873 | 494892 | TATTAATGTACTTGAAGATG | 52 | 415 |
| 750213 | 495043 | 495062 | ATCAGTGTGTGCAGATTCTG | 45 | 416 |
| 750214 | 495050 | 495069 | TCCCATCATCAGTGTGTGCA | 27 | 417 |
| 750215 | 495201 | 495220 | TATGAAAATTAATGTTCAAG | 80 | 418 |
| 750216 | 495233 | 495252 | AAAAATTTTAAACCCCTAG | 76 | 419 |
| 750217 | 495441 | 495460 | TCATGAAAGTAGAGAGTAAG | 68 | 420 |
| 750218 | 495659 | 495678 | TGAAACAATTTAAGTGCCCA | 64 | 421 |
| 750219 | 495718 | 495737 | TTGAAGGGATATCTTCATTC | 106 | 422 |
| 750220 | 495795 | 495814 | TCTGAAAAAAATAGAACAAC | 64 | 423 |
| 750221 | 496202 | 496221 | AATAAAAGACCTGCACAGCA | 66 | 424 |
| 750222 | 496205 | 496224 | CAAAATAAAGACCTGCACA | 48 | 425 |
| 750223 | 496379 | 496398 | AGACCCTTATTTACACCATA | 65 | 426 |
| 750224 | 496557 | 496576 | CTATTAATGAGCTATCTGAA | 37 | 427 |
| 750225 | 496561 | 496580 | TCTACTATTAATGAGCTATC | 45 | 428 |
| 750226 | 496567 | 496586 | TTTCCATCTACTATTAATGA | 39 | 429 |
| 750227 | 496661 | 496680 | GTCTCCACCAGAACAAAACT | 69 | 430 |
| 750228 | 496691 | 496710 | ATGACATAACCATATACAAA | 35 | 431 |
| 750229 | 496697 | 496716 | TTACTGATGACATAACCATA | 71 | 432 |
| 750230 | 496869 | 496888 | CAAAATTCAACCTGGTTTCA | 39 | 433 |
| 750231 | 496927 | 496946 | ATGGAGGGTGTAAATCAAAT | 36 | 434 |
| 750232 | 497148 | 497167 | TGTTACACTGTTATTAAAGC | 28 | 435 |
| 750233 | 497197 | 497216 | AAAACAATGAAGCAGAGGGA | 37 | 436 |
| 750234 | 497299 | 497318 | TAATAAAAGTATCCCACCA | 72 | 437 |
| 750235 | 497429 | 497448 | GAAGTTATGCACCATCAAAT | 46 | 438 |
| 750236 | 497477 | 497496 | TTTACTACTGATATCACCAA | 41 | 439 |
| 750237 | 497680 | 497699 | AGAACAGACTAAGCCCGAAA | 40 | 440 |
| 750238 | 497917 | 497936 | AATTCTGGTGGAAAATACAG | 71 | 441 |
| 750239 | 497984 | 498003 | ACAGAAATCATATCAAATCC | 69 | 442 |

TABLE 7-continued

Reduction of UBE3A-ATS RNA by 8,000 nM 5-10-5 MOE gapmers with mixed PO/PS internucleoside linkages in vitro (40,000 cells/well)

| Compound Number | SEQ ID NO: 1 Start Site | SEQ ID NO: 1 Stop Site | Sequence (5' to 3') | UBE3A-ATS (% UTC) | SEQ ID NO |
|---|---|---|---|---|---|
| 750240 | 498096 | 498115 | ATATATGAAACATTCCATCC | 39 | 443 |
| 750241 | 498127 | 498146 | TTACACTTTAGACCAAACGG | 37 | 444 |
| 750242 | 498179 | 498198 | GGGCAGATTGATCACCTAGA | 25 | 445 |
| 750243 | 498208 | 498227 | CGGGACCTCAATACTCTACT | 37 | 446 |
| 750244 | 498432 | 498451 | TAAATGGAAATTGAGAGCAG | 61 | 447 |
| 750245 | 498842 | 498861 | AAGTCACAACCACATACTGC | 57 | 448 |
| 750246 | 498894 | 498913 | GATTCTCCAACAAAAAGACA | 50 | 449 |
| 750247 | 498942 | 498961 | GACACTAGCAGTTTCTTACC | 30 | 450 |
| 750248 | 499132 | 499151 | GCTTAAAGTAGCCTAAGGAT | 32 | 451 |
| 750249 | 499286 | 499305 | ACAATAAGTTGTAGCTACAA | 61 | 452 |
| 750250 | 499304 | 499323 | TTAAAACAACTGTAGCTAC | 62 | 453 |
| 750251 | 499335 | 499354 | TTCCTATTAGGAGGTTTAAA | 43 | 454 |
| 750252 | 499395 | 499414 | ATAAGTAATTCATAGTCAGA | 44 | 455 |
| 750253 | 499452 | 499471 | GGCTTAAATAAAGACTGCT | 63 | 456 |

TABLE 8

Reduction of UBE3A-ATS RNA by 8,000 nM 5-10-5 MOE gapmers with mixed PO/PS internucleoside linkages in vitro (35,000 cells/well)

| Compound Number | SEQ ID NO: 1 Start Site | SEQ ID NO: 1 Stop Site | Sequence (5' to 3') | UBE3A-ATS (% UTC) | SEQ ID NO |
|---|---|---|---|---|---|
| 617456 | 463905 | 463924 | CAACTGTTACCAAGACTTCA | 34 | 32 |
| 617457 | 465003 | 465022 | ATCTGCGAATAGAGGCCCTC | 44 | 33 |
| 617460 | 466539 | 466558 | TAGGTTGCATAAAGCCAGGC | 45 | 36 |
| 617461 | 466981 | 467000 | CACACATCTTGTTCCCTCAA | 19 | 37 |
| 617557 | 483977 | 483996 | ATCATGTGCATACCCAGGGT | 37 | 172 |
| 749753 | 448285 | 448304 | TAAGATTCCATTGCCAGAAT | 115 | 457 |
| 749754 | 448296 | 448315 | AAGTTTCGCAATAAGATTCC | 103 | 458 |
| 749755 | 448500 | 448519 | TTTCAGTCAGCAAAGGCAGC | 80 | 459 |
| 749756 | 448681 | 448700 | TCTCAACCCTGAAAACAATC | 87 | 460 |
| 749757 | 448989 | 449008 | CATTGGCATTATTCACAGCA | 103 | 461 |
| 749758 | 449031 | 449050 | CTGACTGTCATTCATATAAG | 69 | 462 |
| 749759 | 449067 | 449086 | TGCATAACGATAATCATGTG | 161 | 463 |
| 749760 | 449112 | 449131 | TTGTAGATCCTGGCAAGTAT | 132 | 464 |
| 749761 | 449130 | 449149 | AAAATAAAGTTTCCCTCTT | 64 | 465 |
| 749762 | 449167 | 449186 | CAAAACTTGTCAACATTATA | 129 | 466 |
| 749763 | 449218 | 449237 | CTATATTTAGACCAAATGAG | 91 | 467 |
| 749764 | 449254 | 449273 | CTGACATATATAAATTAGAA | 104 | 468 |

TABLE 8-continued

Reduction of UBE3A-ATS RNA by 8,000 nM 5-10-5 MOE gapmers with mixed PO/PS internucleoside linkages in vitro (35,000 cells/well)

| Compound Number | SEQ ID NO: 1 Start Site | SEQ ID NO: 1 Stop Site | Sequence (5' to 3') | UBE3A-ATS (% UTC) | SEQ ID NO |
|---|---|---|---|---|---|
| 749765 | 449263 | 449282 | CATAGCAACCTGACATATAT | 109 | 469 |
| 749766 | 449279 | 449298 | ACAAACATTGTAAAAACATA | 92 | 470 |
| 749767 | 449337 | 449356 | TTAGAACATGTAGCCATAAT | 69 | 471 |
| 749768 | 449382 | 449401 | AATTGTATTTAATTTAATGA | 102 | 472 |
| 749769 | 449439 | 449458 | ATCATACTGGAGCCAGGTGA | 85 | 473 |
| 749770 | 449545 | 449564 | AATGCAGAAATAAGACCTTC | 88 | 474 |
| 749771 | 449765 | 449784 | CAGTCATCCTTATCTAAGGG | 63 | 475 |
| 749772 | 449786 | 449805 | AAGCCAAAGAGTACTCTTCC | 83 | 476 |
| 749773 | 449820 | 449839 | GATATCTGGGTGTGTCAGCT | 67 | 477 |
| 749774 | 449944 | 449963 | CAACATAAGGTCTTATTGTT | 74 | 478 |
| 749775 | 450083 | 450102 | GGTCTTCTAGAAGCTAATAG | 77 | 479 |
| 749776 | 450092 | 450111 | TTGATAAGTGGTCTTCTAGA | 64 | 480 |
| 749777 | 450204 | 450223 | CAATTCTTTTGAGTGTGTAC | 66 | 481 |
| 749778 | 450205 | 450224 | TCAATTCTTTTGAGTGTGTA | 70 | 482 |
| 749779 | 450511 | 450530 | GTGTGACATTGTCATCATAC | 87 | 483 |
| 749780 | 450710 | 450729 | CTTTATGCTTTCTGTTCTTT | 76 | 484 |
| 749781 | 450733 | 450752 | GAGACTCTCTTTGTTTCTTT | 96 | 485 |
| 749782 | 450906 | 450925 | TTCATTGGAATTCATTGAGC | 94 | 486 |
| 749783 | 450978 | 450997 | CAAGACTTTCTTCTTGTTTT | 115 | 487 |
| 749784 | 451042 | 451061 | AGTCAGCTGTTAATCTTCCT | 85 | 488 |
| 749785 | 451104 | 451123 | TTTTTCTTTGAGCATTTTTA | 104 | 489 |
| 749786 | 451250 | 451269 | TTTAAGTATTTAGAGAACTC | 122 | 490 |
| 749787 | 451286 | 451305 | TACCTAGGCTCACTTGCTTT | 91 | 491 |
| 749788 | 451306 | 451325 | TAGTTGTTGATTTGAATAAC | 87 | 492 |
| 749789 | 451308 | 451327 | TGTAGTTGTTGATTTGAATA | 93 | 493 |
| 749790 | 451389 | 451408 | TTATTTTAAAATCACTTCAG | 96 | 494 |
| 749791 | 451466 | 451485 | TCTTCTTTGGCAAATATATT | 126 | 495 |
| 749792 | 451604 | 451623 | TCCCTTTTTGCCATCTTTTG | 58 | 496 |
| 749793 | 451673 | 451692 | AATAAGTTTCTAATTTACAC | 113 | 497 |
| 749794 | 451834 | 451853 | TCTCATGTGTTTTTGTTCCT | 49 | 498 |
| 749795 | 451954 | 451973 | TAAACCTGGAGATTTTATCC | 128 | 499 |
| 749796 | 452167 | 452186 | GGGAACACACCATTCAGCAG | 38 | 500 |
| 749797 | 452222 | 452241 | AATCTTGTTGACTAAAAGTA | 114 | 501 |
| 749798 | 452255 | 452274 | GTCTCACGCTGTGTGAATCA | 104 | 502 |
| 749799 | 452257 | 452276 | AGGTCTCACGCTGTGTGAAT | 89 | 503 |
| 749800 | 452285 | 452304 | TGCTCCTATTTCAATATGAG | 100 | 504 |

TABLE 8-continued

Reduction of UBE3A-ATS RNA by 8,000 nM 5-10-5 MOE gapmers with mixed PO/PS internucleoside linkages in vitro (35,000 cells/well)

| Compound Number | SEQ ID NO: 1 Start Site | SEQ ID NO: 1 Stop Site | Sequence (5' to 3') | UBE3A-ATS (% UTC) | SEQ ID NO |
|---|---|---|---|---|---|
| 749801 | 452324 | 452343 | ATAAGGTTCAAAAGCCGGTG | 182 | 505 |
| 749802 | 452459 | 452478 | AACTGGTAACATAAATGCAG | 99 | 506 |
| 749803 | 452485 | 452504 | TCAGAGCAAAATGGACTGAC | 142 | 507 |
| 749804 | 452517 | 452536 | TACAAATACCCAGTCTGCAG | 65 | 508 |
| 749805 | 452590 | 452609 | AAGGCCCTTATCATATGCCA | 96 | 509 |
| 749806 | 452661 | 452680 | TCCTATAAAGAAGATATTT | 65 | 510 |
| 749807 | 452715 | 452734 | CTGTGAGAGCTCTGCCCTCA | 93 | 511 |
| 749808 | 453217 | 453236 | GTTAATAGTGTTCTTACATC | 106 | 512 |
| 749809 | 453233 | 453252 | CAGTGGAGTCAAGTTGGTTA | 135 | 513 |
| 749810 | 453350 | 453369 | TCTACTAGCTAACTTTATCA | 109 | 514 |
| 749811 | 453453 | 453472 | AGGATCAAAGCAGAAATTAA | 102 | 515 |
| 749812 | 453814 | 453833 | AAAAACATAGACTTTACTAA | 139 | 516 |
| 749813 | 453899 | 453918 | CACAAAAAACTGATTATATA | 92 | 517 |
| 749814 | 453933 | 453952 | GATCTGTGTTGTTCTTAAGT | 73 | 518 |
| 749815 | 453978 | 453997 | AAGGTAGATTTTATGGCTAC | 68 | 519 |
| 749816 | 454002 | 454021 | GGGCAAAAATAGCAACATAA | 47 | 520 |
| 749817 | 454067 | 454086 | AAGACATAGATGATCCCATA | 89 | 521 |
| 749818 | 454085 | 454104 | TATGAGATGTAAGGAGACAA | 86 | 522 |
| 749819 | 454303 | 454322 | GATAGGAGTAATCTTTTTTT | 86 | 523 |
| 749820 | 454611 | 454630 | AAACAAAAACTCTCCTAAGT | 77 | 524 |
| 749821 | 454657 | 454676 | AGAACTAACAGAATTAAGAG | 89 | 525 |
| 749822 | 454658 | 454677 | CAGAACTAACAGAATTAAGA | 111 | 526 |
| 749823 | 454661 | 454680 | ACACAGAACTAACAGAATTA | 71 | 527 |
| 749824 | 454759 | 454778 | AAAAGAGGAAAACCGAAAG | 88 | 528 |

TABLE 9

Reduction of UBE3A-ATS RNA by 8,000 nM 5-10-5 MOE gapmers with a mixed PO/PS internucleoside linkages in vitro (35,000 cells/well)

| Compound Number | SEQ ID NO: 1 Start Site | SEQ ID NO: 1 Stop Site | Sequence (5' to 3') | UBE3A-ATS (% UTC) | SEQ ID NO |
|---|---|---|---|---|---|
| 617456 | 463905 | 463924 | CAACTGTTACCAAGACTTCA | 40 | 32 |
| 617457 | 465003 | 465022 | ATCTGCGAATAGAGGCCCTC | 49 | 33 |
| 617460 | 466539 | 466558 | TAGGTTGCATAAAGCCAGGC | 28 | 36 |
| 617461 | 466981 | 467000 | CACACATCTTGTTCCCTCAA | 33 | 37 |
| 617557 | 483977 | 483996 | ATCATGTGCATACCCAGGGT | 42 | 172 |
| 749825 | 454828 | 454847 | CATACAAATGTCACTAATAT | 114 | 529 |
| 749826 | 454836 | 454855 | AAGACTAGCATACAAATGTC | 85 | 530 |

TABLE 9-continued

Reduction of UBE3A-ATS RNA by 8,000 nM 5-10-5 MOE gapmers with a mixed PO/PS internucleoside linkages in vitro (35,000 cells/well)

| Compound Number | SEQ ID NO: 1 Start Site | SEQ ID NO: 1 Stop Site | Sequence (5' to 3') | UBE3A-ATS (% UTC) | SEQ ID NO |
|---|---|---|---|---|---|
| 749827 | 454864 | 454883 | ACAGGTGTATATTCCCTATC | 84 | 531 |
| 749828 | 454998 | 455017 | ATATATCTACTGAATATGAT | 108 | 532 |
| 749829 | 455062 | 455081 | CTCAGAACCCTTTGGTCTAA | 66 | 533 |
| 749830 | 455110 | 455129 | CTGACTTGACTTTAATGAAA | 68 | 534 |
| 749831 | 455148 | 455167 | GCATTCAGCTTATAGCAGAA | 58 | 535 |
| 749832 | 455150 | 455169 | CTGCATTCAGCTTATAGCAG | 84 | 536 |
| 749833 | 455193 | 455212 | AAACATTCCTCATACCACAC | 73 | 537 |
| 749834 | 455230 | 455249 | CTTATCCTTGATCCAGACAA | 78 | 538 |
| 749835 | 455436 | 455455 | AATGGGAAATGCTAAAGTTG | 72 | 539 |
| 749836 | 455459 | 455478 | AGTGACACAGTAGTTGTATC | 70 | 540 |
| 749837 | 455485 | 455504 | CAATTTCCTCTCTACCAAGC | 71 | 541 |
| 749838 | 455542 | 455561 | CTTTGTCATTTCATTTATAA | 70 | 542 |
| 749839 | 455603 | 455622 | ATACAGGCATCTCAGCCCTC | 61 | 543 |
| 749840 | 455767 | 455786 | AAAGTACCAAAGTGGCTGCT | 71 | 544 |
| 749841 | 455768 | 455787 | AAAAGTACCAAAGTGGCTGC | 68 | 545 |
| 749842 | 455829 | 455848 | GAAATAATGAACTCACAGTC | 70 | 546 |
| 749843 | 455960 | 455979 | CACAGTTGTTTAGGTCATCT | 119 | 547 |
| 749844 | 457070 | 457089 | GCATGCCATATTTCCTTCTT | 91 | 548 |
| 749845 | 457076 | 457095 | ATAGAGGCATGCCATATTTC | 86 | 549 |
| 749846 | 457151 | 457170 | AGCAAAAATAATCTTAGAAA | 91 | 550 |
| 749847 | 457194 | 457213 | GATTCCAGGCCTTCTATCTC | 80 | 551 |
| 749848 | 457354 | 457373 | GGTCTCAATGAGGAAAAGGA | 34 | 552 |
| 749849 | 457424 | 457443 | ATAAAAGCAAAAGAGAGTTA | 84 | 553 |
| 749850 | 457556 | 457575 | TCTATTCTGAAACCCCAATA | 45 | 554 |
| 749851 | 457705 | 457724 | GACATGCCATCAAGAGAAGA | 59 | 555 |
| 749852 | 457917 | 457936 | ATGTATTAACCAATATTTTG | 51 | 556 |
| 749853 | 457993 | 458012 | AGAACCCACTTGATCTATTA | 53 | 557 |
| 749854 | 458199 | 458218 | TAAAGAATTGAGTACCAAAA | 64 | 558 |
| 749855 | 458268 | 458287 | TATCACATTAATTCCCTCTC | 37 | 559 |
| 749856 | 458289 | 458308 | TAGAATAGAAAAGCATGAAG | 71 | 560 |
| 749857 | 458328 | 458347 | AACAACTATATTTGCTTGTA | 39 | 561 |
| 749858 | 458346 | 458365 | ATAATCACACTAAATCTTAA | 70 | 562 |
| 749859 | 458391 | 458410 | CCTCTATTAAGATCTATGAG | 75 | 563 |
| 749860 | 458438 | 458457 | ACTTCATCAATATTTCCCCA | 31 | 564 |
| 749861 | 458537 | 458556 | GCACTTAAATTTATCAGTTG | 28 | 565 |
| 749862 | 458539 | 458558 | AAGCACTTAAATTTATCAGT | 36 | 566 |

TABLE 9-continued

Reduction of UBE3A-ATS RNA by 8,000 nM 5-10-5 MOE gapmers with a mixed PO/PS internucleoside linkages in vitro (35,000 cells/well)

| Compound Number | SEQ ID NO: 1 Start Site | SEQ ID NO: 1 Stop Site | Sequence (5' to 3') | UBE3A-ATS (% UTC) | SEQ ID NO |
|---|---|---|---|---|---|
| 749863 | 458567 | 458586 | TTAGTATGTCGAGAACTCAA | 24 | 567 |
| 749864 | 458588 | 458607 | AAGTTGAAACACATTTTAGC | 32 | 568 |
| 749865 | 458596 | 458615 | AGGATTAAAAGTTGAAACAC | 30 | 569 |
| 749866 | 458597 | 458616 | CAGGATTAAAAGTTGAAACA | 49 | 570 |
| 749867 | 458608 | 458627 | AATCAGGGAAGCAGGATTAA | 55 | 571 |
| 749868 | 458668 | 458687 | TGATTACTCTTGGCAGTAAT | 58 | 572 |
| 749869 | 458823 | 458842 | TGATAGATACTTGTATTAGC | 14 | 573 |
| 749870 | 458896 | 458915 | CAAATCTAAAGCTCATTTAC | 72 | 574 |
| 749871 | 458908 | 458927 | CTACCAAAATGTCAAATCTA | 56 | 575 |
| 749872 | 459220 | 459239 | GTAACCTGAATATTTCATGA | 37 | 576 |
| 749873 | 459228 | 459247 | AAATAATGGTAACCTGAATA | 56 | 577 |
| 749874 | 459240 | 459259 | AATACATTACTGAAATAATG | 86 | 578 |
| 749875 | 459256 | 459275 | TTTACCTTGACATTCTAATA | 40 | 579 |
| 749876 | 459450 | 459469 | TTAACCTATTTTAATAATAT | 89 | 580 |
| 749877 | 459567 | 459586 | TTAAGTGATTGGAAATAAAA | 82 | 581 |
| 749878 | 459580 | 459599 | CAATTAGGAATATTTAAGTG | 97 | 582 |
| 749879 | 459633 | 459652 | CCAGGCAATGGCTCTTTCAA | 66 | 583 |
| 749880 | 459645 | 459664 | TGTATAGTTTACCCAGGCAA | 37 | 584 |
| 749881 | 460066 | 460085 | CTTTATCAATCTAATCAATT | 65 | 585 |
| 749882 | 460115 | 460134 | ACTTTATAGTGTGGATGGTA | 22 | 586 |
| 749883 | 460146 | 460165 | TTTTAGGGAATTGTCCTGAT | 39 | 587 |
| 749884 | 460211 | 460230 | AAGGAAACACACATAATACC | 46 | 588 |
| 749885 | 460213 | 460232 | GGAAGGAAACACACATAATA | 26 | 589 |
| 749886 | 460272 | 460291 | CACTAAGGACAAAGATATGG | 75 | 590 |
| 749887 | 460303 | 460322 | TATTTGTTCATTCTCAAGAA | 56 | 591 |
| 749888 | 460545 | 460564 | CAACCTGGGCTCTCATCTAA | 41 | 592 |
| 749889 | 460709 | 460728 | AATGCTTGATCTGTGGGCTC | 32* | 593 |
| 749890 | 460749 | 460768 | ATTGTGTACACAGGGATTTG | 22* | 594 |
| 749891 | 460792 | 460811 | AACTGTATACTTTGAAAGTA | 68 | 595 |
| 749892 | 460870 | 460889 | GAAGCAAGTAAGTAAATAAT | 81 | 596 |
| 749893 | 460981 | 461000 | CTTAGATGTGTTTATCCAAA | 25 | 597 |
| 749894 | 460999 | 461018 | GTGTTTTCCATTTTTCTCT | 9 | 598 |
| 749895 | 461027 | 461046 | TGGCTCTATCAAGGCTTCCC | 39 | 599 |
| 749896 | 461039 | 461058 | AATCCTATATTTGGCTCTA | 34 | 600 |

TABLE 10

Reduction of UBE3A-ATS RNA by 10,000 nM 5-10-5 MOE gapmers with mixed PO/PS internucleoside linkages in vitro (40,000 cells/well)

| Compound Number | SEQ ID NO: 1 Start Site | SEQ ID NO: 1 Stop Site | Sequence (5' to 3') | UBE3A-ATS (% UTC) | SEQ ID NO |
|---|---|---|---|---|---|
| 617456 | 463905 | 463924 | CAACTGTTACCAAGACTTCA | 47 | 32 |
| 617457 | 465003 | 465022 | ATCTGCGAATAGAGGCCCTC | 70 | 33 |
| 617460 | 466539 | 466558 | TAGGTTGCATAAAGCCAGGC | 51 | 36 |
| 617461 | 466981 | 467000 | CACACATCTTGTTCCCTCAA | 45 | 37 |
| 617557 | 483977 | 483996 | ATCATGTGCATACCCAGGGT | 29 | 172 |
| 699780 | 479654 | 479673 | AGTAAGGTCTGTTATTCTCC | 122 | 127 |
| 750040 | 470321 | 470340 | GAACTATCCTGCATCCGAGG | 41 | 601 |
| 750041 | 470398 | 470417 | CAACCATCGAGATGATCATA | 70 | 602 |
| 750042 | 471812 | 471831 | TAAATGCTTTTCTAAATCTA | 100 | 603 |
| 750043 | 471892 | 471911 | GCTTTTATAGTGTTGAGGCA | 81 | 604 |
| 750044 | 472153 | 472172 | TTAAGCTCTAATTAAAACAG | 113 | 605 |
| 750045 | 473241 | 473260 | TATTTCACTGGAGCTTTGAT | 107 | 606 |
| 750046 | 473564 | 473583 | AATCATCTACTGATGAACAC | 99 | 607 |
| 750047 | 473573 | 473592 | TCTTTATCTAATCATCTACT | 90 | 608 |
| 750048 | 473576 | 473595 | TTCTCTTTATCTAATCATCT | 111 | 609 |
| 750049 | 473697 | 473716 | AGTTCCTGGAAACCGCCATT | 63 | 610 |
| 750050 | 473789 | 473808 | ATGCTGTTGTACACTAGATC | 82 | 611 |
| 750051 | 473955 | 473974 | GTACACTATTGTTTTGATAT | 44 | 612 |
| 750052 | 474053 | 474072 | CACCCCTAATTTATATTACT | 56 | 613 |
| 750053 | 474069 | 474088 | CATAGGTCAATTCCTTCACC | 47 | 614 |
| 750054 | 474103 | 474122 | TTAATTTAAATAGTTTACAA | 100 | 615 |
| 750055 | 474123 | 474142 | CTAGCTTGAATGGATACCAA | 71 | 616 |
| 750056 | 474169 | 474188 | TAGTGGTTGCCTTAGTATTA | 52 | 617 |
| 750057 | 474198 | 474217 | CAAGTGCTATATTTTTTAA | 95 | 618 |
| 750058 | 474230 | 474249 | TATATATAATTGAGGGCCAC | 116 | 619 |
| 750059 | 474414 | 474433 | ATAATTATAAGATAGGGTTT | 127 | 620 |
| 750060 | 474618 | 474637 | ATTAGTATTGCTGCTCTAGC | 91 | 621 |
| 750061 | 474786 | 474805 | CCAACTGTAATCATTGATTT | 79 | 622 |
| 750062 | 474865 | 474884 | GATAATGTGTAGTTTTTTAT | 82 | 623 |
| 750063 | 474878 | 474897 | TAAGGTGTTGTATGATAATG | 78 | 624 |
| 750064 | 474953 | 474972 | AATATGTGTCATCCTGAAGA | 93 | 625 |
| 750065 | 475066 | 475085 | TCATTGTGAATTTCCCACAT | 81 | 626 |
| 750066 | 475233 | 475252 | TTAGGGATATACTGTTATAC | 72 | 627 |
| 750067 | 475268 | 475287 | AAAATTAGGTTATTGGATTG | 103 | 628 |
| 750068 | 475293 | 475312 | CTTTCACTCTCATTTCTTAA | 91 | 629 |
| 750069 | 475397 | 475416 | ACTTTCAAGTTTATTAATTT | 115 | 630 |
| 750070 | 475495 | 475514 | TACTTTCATTTATGTCTAGT | 78 | 631 |

TABLE 10-continued

Reduction of UBE3A-ATS RNA by 10,000 nM 5-10-5 MOE gapmers with mixed PO/PS internucleoside linkages in vitro (40,000 cells/well)

| Compound Number | SEQ ID NO: 1 Start Site | SEQ ID NO: 1 Stop Site | Sequence (5' to 3') | UBE3A-ATS (% UTC) | SEQ ID NO |
|---|---|---|---|---|---|
| 750071 | 475503 | 475522 | GATATCTATACTTTCATTTA | 125 | 632 |
| 750072 | 475628 | 475647 | CATGTTTTACACCAGCTGT | 87 | 633 |
| 750073 | 475693 | 475712 | TTACTTACTCAATTTCTTCT | 97 | 634 |
| 750074 | 476072 | 476091 | GTTTCAGCAGTTTCTGCTCC | 85 | 635 |
| 750075 | 476164 | 476183 | GGGCACTTAGGAGTTCCTAA | 80 | 636 |
| 750076 | 476337 | 476356 | CTCTGAGAGTGTTTAGAAAT | 55 | 637 |
| 750077 | 476350 | 476369 | GTGAAAGAAAATGCTCTGAG | 62 | 638 |
| 750078 | 476405 | 476424 | TACATCAGACAAGGCTCAGG | 91 | 639 |
| 750079 | 476845 | 476864 | TTCTATAATCTTATGGTTAA | 77 | 640 |
| 750080 | 476851 | 476870 | GAAGTGTTCTATAATCTTAT | 74 | 641 |
| 750081 | 477296 | 477315 | GTGAAAATTTTGTAGGTTGC | 110 | 642 |
| 750082 | 478347 | 478366 | TACAATCAGTGTCTTTCACC | 78 | 643 |
| 750083 | 478472 | 478491 | ATGGTTAGGGCTATGTTATG | 96 | 644 |
| 750084 | 478542 | 478561 | GAAATAAAACGCAATGTATC | 118 | 645 |
| 750085 | 478710 | 478729 | CTTGCATGTTGCCTTTTTCT | 129 | 646 |
| 750086 | 479037 | 479056 | AACTCTCTGCCATTATTACT | 81 | 647 |
| 750087 | 479330 | 479349 | TAATCTCACTGGATACAGAA | 107 | 648 |
| 750088 | 479468 | 479487 | AAACATTTTACCATTTTATA | 133 | 649 |
| 750089 | 479644 | 479663 | GTTATTCTCCCTCTTGAACC | 82 | 650 |
| 750090 | 479647 | 479666 | TCTGTTATTCTCCCTCTTGA | 86 | 651 |
| 750091 | 479649 | 479668 | GGTCTGTTATTCTCCCTCTT | 51 | 652 |
| 750092 | 479652 | 479671 | TAAGGTCTGTTATTCTCCCT | 52 | 653 |
| 750093 | 479656 | 479675 | AAAGTAAGGTCTGTTATTCT | 92 | 654 |
| 750094 | 479659 | 479678 | CTAAAAGTAAGGTCTGTTAT | 74 | 655 |
| 750095 | 479661 | 479680 | GACTAAAAGTAAGGTCTGTT | 70 | 656 |
| 750096 | 479664 | 479683 | AATGACTAAAAGTAAGGTCT | 133 | 657 |
| 750097 | 480219 | 480238 | AAAGATATAGAACTGAAAAG | 128 | 658 |
| 750098 | 480286 | 480305 | GTTGGAGACTTCAATTTCCT | 89 | 659 |
| 750099 | 480361 | 480380 | AAACAACAGAGCCTCAAATA | 114 | 660 |
| 750100 | 480441 | 480460 | AAAATACCACAAAGATAGGC | 38 | 661 |
| 750101 | 480530 | 480549 | AAGAATGGAAAGATGTATC | 57 | 662 |
| 750102 | 480533 | 480552 | TAAAAGAATGGAAAGATGT | 99 | 663 |
| 750103 | 480648 | 480667 | AATTTTACCTCAGTATAAAA | 106 | 664 |
| 750104 | 480698 | 480717 | ATTACCAAATGCCACTGTAT | 59 | 665 |
| 750105 | 480714 | 480733 | GTTGCATAACATGTGTATTA | 65 | 666 |
| 750106 | 480787 | 480806 | AATTAACTGCTTAATGAGTA | 145 | 667 |

TABLE 10-continued

Reduction of UBE3A-ATS RNA by 10,000 nM 5-10-5 MOE gapmers with mixed PO/PS internucleoside linkages in vitro (40,000 cells/well)

| Compound Number | SEQ ID NO: 1 Start Site | SEQ ID NO: 1 Stop Site | Sequence (5' to 3') | UBE3A-ATS (% UTC) | SEQ ID NO |
|---|---|---|---|---|---|
| 750107 | 480898 | 480917 | ATAAAGGTCACTTATTGTAT | 89 | 668 |
| 750108 | 480968 | 480987 | AATAAAACTGATACATACTA | 101 | 669 |
| 750109 | 481010 | 481029 | AATCAACTTTTAGCTATACA | 119 | 670 |
| 750110 | 481027 | 481046 | TATCATTATGACCTAGGAAT | 69 | 671 |

TABLE 11

Reduction of UBE3A-ATS RNA by 8,000 nM 5-10-5 MOE gapmers with mixed PO/PS internucleoside linkages in vitro (40,000 cells/well)

| Compound Number | SEQ ID NO: 1 Start Site | SEQ ID NO: 1 Stop Site | Sequence (5' to 3') | UBE3A-ATS (% UTC) | SEQ ID NO |
|---|---|---|---|---|---|
| 617456 | 463905 | 463924 | CAACTGTTACCAAGACTTCA | 16 | 32 |
| 617457 | 465003 | 465022 | ATCTGCGAATAGAGGCCCTC | 21 | 33 |
| 617460 | 466539 | 466558 | TAGGTTGCATAAAGCCAGGC | 24 | 36 |
| 617461 | 466981 | 467000 | CACACATCTTGTTCCCTCAA | 15 | 37 |
| 617557 | 483977 | 483996 | ATCATGTGCATACCCAGGGT | 12 | 172 |
| 750254 | 499480 | 499499 | ACTGGAATTACTAAAAGGGA | 62 | 672 |
| 750255 | 499621 | 499640 | AGTAGAGAGTGGGATGGTAT | 53 | 673 |
| 750256 | 499691 | 499710 | TAAGAAACATCACATTCAAG | 67 | 674 |
| 750257 | 500139 | 500158 | TGAACAGAATGAGAAGTTTA | 82 | 675 |
| 750258 | 500141 | 500160 | TCTGAACAGAATGAGAAGTT | 69 | 676 |
| 750259 | 500285 | 500304 | TGGTGTACATTGGATATGAA | 24 | 677 |
| 750260 | 500319 | 500338 | TTTCTAACATTTACTGTGGA | 83 | 678 |
| 750261 | 500367 | 500386 | TTCTAACATACTAATTAGCA | 41 | 679 |
| 750262 | 500384 | 500403 | CACCAATGCAAGCCAGCTTC | 28 | 680 |
| 750263 | 500526 | 500545 | TGTTTAGAGGTCAAGCCCTG | 75 | 681 |
| 750264 | 500570 | 500589 | ATCAGTCAAAACATGTTCTG | 56 | 682 |
| 750265 | 500629 | 500648 | TATTACACAAGGTATTGGTA | 35 | 683 |
| 750266 | 500639 | 500658 | ATGAAAGGTTTATTACACAA | 34 | 684 |
| 750267 | 500760 | 500779 | AATCAATTTGTGCCACAGGC | 34 | 685 |
| 750268 | 500786 | 500805 | GCAGCTTATAAAGAGAGCCA | 78 | 686 |
| 750269 | 500860 | 500879 | TTTGGTAGGTAACTACGGGT | 35 | 687 |
| 750270 | 500882 | 500901 | TCGGATATAGCTTTTACATA | 14 | 688 |
| 750271 | 501004 | 501023 | AAACTAAGCACATCCGATAG | 60 | 689 |
| 750272 | 501060 | 501079 | ATCATCTTTGATTTGACTTT | 37 | 690 |
| 750273 | 501091 | 501110 | TTCTTTATGAATCTTTGAAA | 51 | 691 |
| 750274 | 501151 | 501170 | GTAAAGAGCCACCTAAGGGA | 40 | 692 |
| 750275 | 501165 | 501184 | ATGAGATGGGCACAGTAAAG | 33 | 693 |

TABLE 11-continued

Reduction of UBE3A-ATS RNA by 8,000 nM 5-10-5 MOE gapmers with mixed PO/PS internucleoside linkages in vitro (40,000 cells/well)

| Compound Number | SEQ ID NO: 1 Start Site | SEQ ID NO: 1 Stop Site | Sequence (5' to 3') | UBE3A-ATS (% UTC) | SEQ ID NO |
|---|---|---|---|---|---|
| 750276 | 501391 | 501410 | TCCCCAGATAATGCATAGAT | 49 | 694 |
| 750277 | 501437 | 501456 | GGTGGCATAGAAGGCAGCAC | 74 | 695 |
| 750278 | 501549 | 501568 | GGATGCAGCAGGAGAAGAAA | 42 | 696 |
| 750279 | 501576 | 501595 | AAGGCAAGGCTAAGGAGTGC | 27 | 697 |
| 750280 | 501679 | 501698 | AGAGAGCTAGAGCTAGGACT | 17 | 698 |
| 750281 | 501694 | 501713 | ATCCCAAAGTTACACAGAGA | 58 | 699 |
| 750282 | 501703 | 501722 | CTTTGGGACATCCCAAAGTT | 73 | 75 |
| 750283 | 501752 | 501771 | CACCTGTATCCAAAATTCAA | 47 | 700 |
| 750284 | 501788 | 501807 | CATATCTGAAGCACAGAGAG | 39 | 701 |
| 750285 | 501860 | 501879 | CAGTCTGCTCTGCTGCTCTG | 66 | 702 |
| 750286 | 501862 | 501881 | TCCAGTCTGCTCTGCTGCTC | 67 | 703 |
| 750287 | 501882 | 501901 | AGCTCAGAGGCAGCAGGAGC | 47 | 704 |
| 750288 | 502030 | 502049 | CTAAGCTCCATATTTAAATC | 69 | 705 |
| 750289 | 502049 | 502068 | TTCAGGCTTCCTTCACAGCC | 69 | 706 |
| 750290 | 502052 | 502071 | TTCTTCAGGCTTCCTTCACA | 44 | 707 |
| 750291 | 502138 | 502157 | GGAATCAGTGCTACCCATTA | 23 | 708 |
| 750292 | 502194 | 502213 | TTAGCCATCATTTTATTCTC | 12 | 709 |
| 750293 | 502341 | 502360 | GGCCCATTTTTTCAATCTCA | 43 | 710 |
| 750294 | 502404 | 502423 | CATGGTCTTCCTTGACTACA | 40 | 711 |
| 750295 | 502580 | 502599 | AAGCCAATGCGCAAGAAAAG | 42 | 712 |
| 750296 | 503121 | 503140 | CATCCAGTTAATCTCTGACA | 31 | 713 |
| 750297 | 503125 | 503144 | CTCGCATCCAGTTAATCTCT | 38 | 714 |
| 750298 | 503145 | 503164 | ACACCATCCCAGAAATGGTC | 75 | 715 |
| 750299 | 503180 | 503199 | TTTCTGACTCCCTATCCAGT | 44 | 716 |
| 750300 | 503376 | 503395 | TTCCCCAGGGTCATAGGAGT | 71 | 717 |
| 750301 | 503442 | 503461 | GCACTGTCCCAGTTGGATTA | 27 | 718 |
| 750302 | 503490 | 503509 | ACCCAGCAAAATGTGGGTCT | 119 | 719 |
| 750303 | 503504 | 503523 | TTGGTTGTGGTGAAACCCAG | 79 | 720 |
| 750304 | 503533 | 503552 | TGTTAAAGAGAAAAGAATC | 77 | 721 |
| 750305 | 503550 | 503569 | TTGCAGTGATGTACTGATGT | 26 | 722 |
| 750306 | 503599 | 503618 | TTGTTTTTATAAGCAATTAG | 59 | 723 |
| 750307 | 503645 | 503664 | TATAAATATGCCCATATGCT | 28 | 724 |
| 750308 | 503656 | 503675 | CTGCCTGCAACTATAAATAT | 45 | 725 |
| 750309 | 503825 | 503844 | GTATCTCCTAGCCCAGTGCC | 32 | 726 |
| 750310 | 503828 | 503847 | ACTGTATCTCCTAGCCCAGT | 64 | 727 |
| 750311 | 503895 | 503914 | GATTGCTTTATTGCAACTAA | 63 | 728 |

TABLE 11-continued

Reduction of UBE3A-ATS RNA by 8,000 nM 5-10-5 MOE gapmers with mixed PO/PS internucleoside linkages in vitro (40,000 cells/well)

| Compound Number | SEQ ID NO: 1 Start Site | SEQ ID NO: 1 Stop Site | Sequence (5' to 3') | UBE3A-ATS (% UTC) | SEQ ID NO |
|---|---|---|---|---|---|
| 750312 | 503936 | 503955 | CTTAAATAGTAGGAAAGCCA | 14 | 729 |
| 750313 | 503973<br>508739 | 503992<br>508758 | ACACTGTACAGGAGGGTGTC | 25 | 155 |
| 750314 | 503975<br>508741 | 503994<br>508760 | GCACACTGTACAGGAGGGTG | 30 | 730 |
| 750315 | 503977<br>508743 | 503996<br>508762 | CTGCACACTGTACAGGAGGG | 17 | 79 |
| 750316 | 503979<br>508745 | 503998<br>508764 | CACTGCACACTGTACAGGAG | 41 | 731 |
| 750317 | 503981<br>508747 | 504000<br>508766 | TTCACTGCACACTGTACAGG | 33 | 156 |
| 750318 | 503983<br>508749 | 504002<br>508768 | GATTCACTGCACACTGTACA | 34 | 732 |
| 750319 | 503985<br>508751 | 504004<br>508770 | TTGATTCACTGCACACTGTA | 19 | 80 |
| 750320 | 503987<br>508753 | 504006<br>508772 | TGTTGATTCACTGCACACTG | 28 | 733 |
| 750321 | 503991<br>508757 | 504010<br>508776 | ATGATGTTGATTCACTGCAC | 19 | 734 |
| 750322 | 503993<br>508759 | 504012<br>508778 | AAATGATGTTGATTCACTGC | 43 | 157 |
| 750323 | 503995<br>508761 | 504014<br>508780 | GGAAATGATGTTGATTCACT | 29 | 735 |
| 750324 | 503998 | 504017 | TGTGGAAATGATGTTGATTC | 50 | 736 |
| 750325 | 504090 | 504109 | CAGTATCTTAACTGGTGAAC | 15 | 737 |

TABLE 12

Reduction of UBE3A-ATS RNA by 8,000 nM 5-10-5 MOE gapmers with mixed PO/PS internucleoside linkages in vitro (40,000 cells/well)

| Compound Number | SEQ ID NO: 1 Start Site | SEQ ID NO: 1 Stop Site | Sequence (5' to 3') | UBE3A-ATS (% UTC) | SEQ ID NO |
|---|---|---|---|---|---|
| 617456 | 463905 | 463924 | CAACTGTTACCAAGACTTCA | 25 | 32 |
| 617457 | 465003 | 465022 | ATCTGCGAATAGAGGCCCTC | 27 | 33 |
| 617460 | 466539 | 466558 | TAGGTTGCATAAAGCCAGGC | 25 | 36 |
| 617461 | 466981 | 467000 | CACACATCTTGTTCCCTCAA | 17 | 37 |
| 617557 | 483977 | 483996 | ATCATGTGCATACCCAGGGT | 13 | 172 |
| 699781 | 483977 | 483996 | ATCATGTGCATACCCAGGGT | 20 | 172 |
| 750111 | 481036 | 481055 | ACATAGAATTATCATTATGA | 49 | 738 |
| 750112 | 481073 | 481092 | ACTGTGGAAAAACTTTGGCA | 38 | 129 |
| 750113 | 481398 | 481417 | ATGGGTTAAAATACTTATAA | 79 | 739 |
| 750114 | 481451 | 481470 | TAAACCTTTGTGCATAATG | 32 | 740 |
| 750115 | 481487 | 481506 | CAACAACAAAAGCGGATAAA | 50 | 741 |

TABLE 12-continued

Reduction of UBE3A-ATS RNA by 8,000 nM 5-10-5 MOE gapmers with mixed PO/PS internucleoside linkages in vitro (40,000 cells/well)

| Compound Number | SEQ ID NO: 1 Start Site | SEQ ID NO: 1 Stop Site | Sequence (5' to 3') | UBE3A-ATS (% UTC) | SEQ ID NO |
|---|---|---|---|---|---|
| 750116 | 481524 | 481543 | ATGACACTAGGTTTTGCAAA | 34 | 742 |
| 750117 | 481529 | 481548 | ACCTCATGACACTAGGTTTT | 26 | 743 |
| 750118 | 481571 | 481590 | GTATAGACCCAAACTATAAA | 35 | 744 |
| 750119 | 481573 | 481592 | ATGTATAGACCCAAACTATA | 55 | 745 |
| 750120 | 481725 | 481744 | TGATCTCTTCAACAAATTGT | 82 | 746 |
| 750121 | 482139 | 482158 | AATGTTGCCGAAAGAAAAGA | 73 | 747 |
| 750122 | 482156 | 482175 | ACAAGTGTCATATACTAAAT | 51 | 748 |
| 750123 | 482174 | 482193 | AAATTTAACCAAGGAGTTAC | 48 | 749 |
| 750124 | 482246 | 482265 | AGCCATCTAAAAGAGAAATT | 38 | 750 |
| 750125 | 482396 | 482415 | GATCAAGAAGTAAAATTATC | 74 | 751 |
| 750126 | 482685 | 482704 | CACATGATAATCTCAATTAT | 52 | 752 |
| 750127 | 482916 | 482935 | GAAAAATTCACTCTATAGGT | 58 | 753 |
| 750128 | 482988 | 483007 | CTATAGAGAGATAGATATTA | 52 | 754 |
| 750129 | 483017 | 483036 | AGAAAAATGTCTTTCCAAAT | 43 | 755 |
| 750130 | 483089 | 483108 | CAAATACTTAAATCAACTGT | 50 | 756 |
| 750131 | 483255 | 483274 | GGAGGGAGGAAAATTATTTC | 14 | 757 |
| 750132 | 483297 | 483316 | AGCAAACAACAGCAACATGC | 56 | 758 |
| 750133 | 483323 | 483342 | AAAATACTTTAGAAAAGTCA | 73 | 759 |
| 750134 | 483365 | 483384 | CAGAATTCAATGGACCCACA | 33 | 760 |
| 750135 | 483809 | 483828 | TCGGCAAAGGCATTATTATT | 32 | 761 |
| 750136 | 483920 | 483939 | GCTTTCACCTATAGGTGGCC | 45 | 762 |
| 750137 | 483928 | 483947 | GATGTTAAGCTTTCACCTAT | 25 | 763 |
| 750138 | 483967 | 483986 | TACCCAGGGTAGGATTCATG | 17 | 764 |
| 750139 | 483970 | 483989 | GCATACCCAGGGTAGGATTC | 13 | 765 |
| 750140 | 483972 | 483991 | GTGCATACCCAGGGTAGGAT | 9 | 766 |
| 750141 | 483975 | 483994 | CATGTGCATACCCAGGGTAG | 16 | 767 |
| 750142 | 483979 | 483998 | AGATCATGTGCATACCCAGG | 34 | 768 |
| 750143 | 483982 | 484001 | AGAAGATCATGTGCATACCC | 36 | 769 |
| 750144 | 483984 | 484003 | TAAGAAGATCATGTGCATAC | 44 | 770 |
| 750145 | 483987 | 484006 | AATTAAGAAGATCATGTGCA | 119 | 771 |
| 750146 | 484085 | 484104 | GTTCAGATGAACAATAAGCA | 45 | 772 |
| 750147 | 484311 | 484330 | ACTCATGCTGGTTACTAGGG | 30 | 773 |
| 750148 | 484598 | 484617 | TCATATGGGTGGTCGCTAAT | 24 | 774 |
| 750149 | 484719 | 484738 | ACACTAACGATGAACTCTAA | 55 | 775 |
| 750150 | 484721 | 484740 | TAACACTAACGATGAACTCT | 42 | 776 |

TABLE 12-continued

Reduction of UBE3A-ATS RNA by 8,000 nM 5-10-5 MOE gapmers with mixed PO/PS internucleoside linkages in vitro (40,000 cells/well)

| Compound Number | SEQ ID NO: 1 Start Site | SEQ ID NO: 1 Stop Site | Sequence (5' to 3') | UBE3A-ATS (% UTC) | SEQ ID NO |
|---|---|---|---|---|---|
| 750151 | 485136 | 485155 | TTAAAACTCAACCCAGTGCA | 29 | 777 |
| 750152 | 485344 | 485363 | ATTCCTAGAGAAAACCTAGG | 82 | 778 |
| 750153 | 485478 | 485497 | AGAACAATGTTTCTTATGAA | 72 | 779 |
| 750154 | 485865 | 485884 | GAAACTGGGATATTACCAAT | 45 | 780 |
| 750155 | 485871 | 485890 | AAAATGGAAACTGGGATATT | 37 | 781 |
| 750156 | 486052 | 486071 | AAAAATTAAAGGCCAACAGA | 46 | 782 |
| 750157 | 486157 | 486176 | TTATGGCAGGTAGTGAAAGG | 47 | 783 |
| 750158 | 486265 | 486284 | ACAATATGCAAAAATTAAAT | 74 | 784 |
| 750159 | 486400 | 486419 | CATTCTCCAACATAGATCCT | 41 | 785 |
| 750160 | 486568 | 486587 | CAATAATAGAGACTTTACCA | 79 | 786 |
| 750161 | 486812 | 486831 | ATATATTATGTAAATGTAAC | 78 | 787 |
| 750162 | 486824 | 486843 | AGGATGGAAAAGATATATTA | 76 | 788 |
| 750163 | 486842 | 486861 | AAACAGGTTGAAAATGAAAG | 79 | 789 |
| 750164 | 487049 | 487068 | AAAGGCAATATTGAAGGAAA | 72 | 790 |
| 750165 | 487267 | 487286 | GAATTGAGTTAATAATTCCT | 57 | 791 |
| 750166 | 487304 | 487323 | TCTCACAGAGAAAGAGGTGG | 21 | 792 |
| 750167 | 487314 | 487333 | TTTTCTATAATCTCACAGAG | 43 | 793 |
| 750168 | 487341 | 487360 | GGCTCAGAAAACATCCTTTT | 35 | 794 |
| 750169 | 487437 | 487456 | ATTTAATTTACACTTAATTA | 93 | 795 |
| 750170 | 487464 | 487483 | ACTTTCCTCTGCTTATAACT | 22 | 796 |
| 750171 | 487469 | 487488 | ACTATACTTTCCTCTGCTTA | 28 | 797 |
| 750172 | 487589 | 487608 | AGCAATTAGAAATCACATGA | 21 | 798 |
| 750173 | 487724 | 487743 | AAAGCAGTAAACAATAAGTG | 53 | 799 |
| 750174 | 487739 | 487758 | TCATATGTAAATCCAAAAGC | 57 | 800 |
| 750175 | 487772 | 487791 | CATTGTAAGGATAAGAGATA | 27 | 801 |
| 750176 | 487784 | 487803 | CAGTTTGAATTACATTGTAA | 29 | 802 |
| 750177 | 487804 | 487823 | AATTGAACTTAAATTGGCAT | 32 | 803 |
| 750178 | 487831 | 487850 | CTGCATAGGAGTAGAGTTTT | 31 | 804 |
| 750179 | 487877 | 487896 | AAGATGGAATTTGCGACATC | 50 | 805 |
| 750180 | 487921 | 487940 | ACATAAAAATGTATAAATCC | 70 | 806 |
| 750181 | 488018 | 488037 | ACTGATAAAGGTAAGCACAT | 31 | 807 |

TABLE 13

Reduction of UBE3A-ATS RNA by 8,000 nM 5-10-5 MOE gapmers with mixed PO/PS internucleoside linkages in vitro (40,000 cells/well)

| Compound Number | SEQ ID NO: 1 Start Site | SEQ ID NO: 1 Stop Site | Sequence (5' to 3') | UBE3A-ATS (% UTC) | SEQ ID NO |
|---|---|---|---|---|---|
| 617456 | 463905 | 463924 | CAACTGTTACCAAGACTTCA | 13 | 32 |
| 617457 | 465003 | 465022 | ATCTGCGAATAGAGGCCCTC | 38 | 33 |
| 617460 | 466539 | 466558 | TAGGTTGCATAAAGCCAGGC | 16 | 36 |
| 617461 | 466981 | 467000 | CACACATCTTGTTCCCTCAA | 11 | 37 |
| 617557 | 483977 | 483996 | ATCATGTGCATACCCAGGGT | 13 | 172 |
| 750398 | 510078 | 510097 | CAGAGAGGAGAGAAGGACAA | 45 | 808 |
| 750399 | 510104 | 510123 | GGCTAGGAAAATTCTCCTGG | 39 | 809 |
| 750400 | 510207 | 510226 | AGGGAGAGCTGTCCTAAGGC | 27 | 810 |
| 750401 | 510214 | 510233 | GATATCCAGGGAGAGCTGTC | 23 | 811 |
| 750402 | 510269 | 510288 | TTGAAGGGAAAATTATTAAT | 43 | 812 |
| 750403 | 510319 | 510338 | AGCTGGACGGACAGTGTTGC | 47 | 813 |
| 750404 | 510407 | 510426 | CAAGACATGCTAGGGACTCT | 38 | 814 |
| 750405 | 510408 | 510427 | CCAAGACATGCTAGGGACTC | 30 | 815 |
| 750406 | 510416 | 510435 | GCCACAGTCCAAGACATGCT | 49 | 816 |
| 750407 | 510442 | 510461 | GCAGATAATCTGAAGATAGA | 43 | 817 |
| 750408 | 510515 | 510534 | TTTATTACAAACTGAAAGAG | 42 | 818 |
| 750409 | 510609 | 510628 | GGTCAGATAATGAGGGCCTT | 20 | 819 |
| 750410 | 510701 | 510720 | AGGATAGGTGTATGTGAGTG | 31 | 820 |
| 750411 | 510729 | 510748 | ATGAAGGTCAAGCCGAATCT | 50 | 821 |
| 750412 | 510798 | 510817 | AAAAGAAGTATGTGAAAGTA | 45 | 822 |
| 750413 | 510997 | 511016 | TGTCTCTAATCCTATTCCAA | 12 | 823 |
| 750414 | 511100 | 511119 | AGTCTTCATGATTTGGTAAA | 37 | 824 |
| 750415 | 511341 | 511360 | AGTAAGAGGCAGAATTATGT | 54 | 825 |
| 750416 | 511441 | 511460 | GGGCAGCAACAGCTCTTGAA | 16 | 826 |
| 750417 | 511503 | 511522 | TAATAATTAACAGTGACTGG | 24 | 827 |
| 750418 | 511529 | 511548 | AAGTCATTCCCCACCCTGGC | ND | 828 |
| 750419 | 511555 | 511574 | TCCAGCAGGGTGTATTCCAG | 47 | 829 |
| 750420 | 511567 | 511586 | TCAGCTGTGGTTTCCAGCAG | 34 | 830 |
| 750421 | 511579 | 511598 | GCTTAGAGAATCTCAGCTGT | 49 | 831 |
| 750422 | 511594 | 511613 | GGTTGGAAGCTGCCAGCTTA | 22 | 832 |
| 750423 | 511668 | 511687 | AATGGACTGCCGGCCTGGAG | 47 | 833 |
| 750424 | 511893 | 511912 | TGAACTACTTGGAGACCTTC | 55 | 834 |
| 750425 | 511895 | 511914 | AGTGAACTACTTGGAGACCT | 45 | 835 |
| 750426 | 512282 | 512301 | TCTTTTATTAAACCTAGTTT | 60 | 836 |
| 750427 | 512318 | 512337 | TTAGCTAGCTGTGGGTTTGC | 25 | 837 |
| 750428 | 512392 | 512411 | ACAAGAGCAGACATCTTTTT | 60 | 838 |
| 750429 | 512564 | 512583 | TGTAGCTTTTCTAAAATTCT | 34 | 839 |

TABLE 13-continued

Reduction of UBE3A-ATS RNA by 8,000 nM 5-10-5 MOE gapmers with mixed PO/PS internucleoside linkages in vitro (40,000 cells/well)

| Compound Number | SEQ ID NO: 1 Start Site | SEQ ID NO: 1 Stop Site | Sequence (5' to 3') | UBE3A-ATS (% UTC) | SEQ ID NO |
|---|---|---|---|---|---|
| 750430 | 512570 | 512589 | GTATATTGTAGCTTTTCTAA | 16 | 840 |
| 750431 | 513010 | 513029 | CTTGATGGCTGTAGCTTGGT | 21 | 841 |
| 750432 | 513074 | 513093 | TTTCTGGATTCTCAGTCTTA | 28 | 842 |
| 750433 | 513189 | 513208 | TGCATTGGTATCTGTATATC | 23 | 843 |
| 750434 | 513219 | 513238 | GTTTCCTATTTCATCCATTT | 25 | 844 |
| 750435 | 513378 | 513397 | CTGGAGTGTAAGTAAATTCA | 33 | 845 |
| 750436 | 513442 | 513461 | ATACTCTTTCCACATTTCAG | 19 | 846 |
| 750437 | 513450 | 513469 | TCCTCTTGATACTCTTTCCA | 34 | 847 |
| 750438 | 513459 | 513478 | CTTAGGGTCTCCTCTTGATA | 32 | 848 |
| 750439 | 513467 | 513486 | CAGAGTGTCTTAGGGTCTCC | 27 | 849 |
| 750440 | 513620 | 513639 | ATATTTCTCAAATACTCTTC | 48 | 850 |
| 750441 | 513760 | 513779 | TGTGCTAGAACACTATCTTG | 62 | 851 |
| 750442 | 513793 | 513812 | TGACTCTCATCTCCCTCTTC | 70 | 852 |
| 750443 | 513796 | 513815 | CCCTGACTCTCATCTCCCTC | 50 | 853 |
| 750444 | 513875 | 513894 | CCTTCCTTCTTTATACTGCC | 46 | 854 |
| 750445 | 513944 | 513963 | CATCAAAATCTCTCATTCCT | 22 | 855 |
| 750446 | 513947 | 513966 | AATCATCAAAATCTCTCATT | 35 | 856 |
| 750447 | 513951 | 513970 | CCCCAATCATCAAAATCTCT | 70 | 857 |
| 750448 | 514039 | 514058 | TAGTCAGTAGTCCTAAAAAC | 58 | 858 |
| 750449 | 514073 | 514092 | AGACCTCTGTCTCTGGGATT | 54 | 859 |
| 750450 | 514159 | 514178 | AAAGTCCTTACCTGTTCTTG | 36 | 860 |
| 750451 | 514326 | 514345 | TTCACCGAAAGTACAGTCTT | 54 | 861 |
| 750452 | 514330 | 514349 | TAGTTTCACCGAAAGTACAG | ND | 862 |
| 750453 | 514439 | 514458 | AAGTCTTTTCTCCCCTCCCC | 28 | 863 |
| 750454 | 514504 | 514523 | TCAACAGTGTTAGTGTGTAA | 45 | 864 |
| 750455 | 514513 | 514532 | CCTTTTACCTCAACAGTGTT | 35 | 865 |
| 750456 | 514673 | 514692 | AGACTAGTCCCTGTGTAGTC | 27 | 866 |
| 750457 | 514676 | 514695 | CCAAGACTAGTCCCTGTGTA | 40 | 867 |
| 750458 | 514701 | 514720 | AACTGTCAGAGGAAGAAATG | 62 | 868 |
| 750459 | 514861 | 514880 | CGAACAGAACTTGCCGATGT | 37 | 869 |
| 750460 | 514920 | 514939 | TTGTATAGGGAGATGATAGA | 39 | 870 |
| 750461 | 515069 | 515088 | TAACCTTTTATTATTATAGA | 55 | 871 |
| 750462 | 515111 | 515130 | TAAACTAAAGTAACTGGTTT | 55 | 872 |
| 750463 | 515143 | 515162 | CCAGGAAGCTCTGGAGGGAA | 23 | 873 |
| 750464 | 515187 | 515206 | ACTCTATTATATATTTTGGT | 28 | 874 |
| 750465 | 515215 | 515234 | GTTATAAAAGTACTTTTTTT | 78 | 875 |

TABLE 13-continued

Reduction of UBE3A-ATS RNA by 8,000 nM 5-10-5 MOE gapmers with mixed PO/PS internucleoside linkages in vitro (40,000 cells/well)

| Compound Number | SEQ ID NO: 1 Start Site | SEQ ID NO: 1 Stop Site | Sequence (5' to 3') | UBE3A-ATS (% UTC) | SEQ ID NO |
|---|---|---|---|---|---|
| 750466 | 515242 | 515261 | GGATACTTCCTCTACCCCAA | 30 | 876 |
| 750467 | 515247 | 515266 | ACAGTGGATACTTCCTCTAC | 40 | 877 |
| 750468 | 515318 | 515337 | CTGCCTTTTCATTACTATTT | 30 | 878 |
| 750469 | 515500 | 515519 | GTTTTAAAGTGGTAATTGAA | 44 | 879 |

TABLE 14

Reduction of UBE3A-ATS RNA by 7,000 nM 5-10-5 MOE gapmers with mixed PO/PS internucleoside linkages in vitro (37,000 cells/well)

| Compound Number | SEQ ID NO: 1 Start Site | SEQ ID NO: 1 Stop Site | Sequence (5' to 3') | UBE3A-ATS (% UTC) | SEQ ID NO |
|---|---|---|---|---|---|
| 617557 | 483977 | 483996 | ATCATGTGCATACCCAGGGT | 44 | 172 |
| 699781 | 483977 | 483996 | ATCATGTGCATACCCAGGGT | 51 | 172 |
| 749882 | 460115 | 460134 | ACTTTATAGTGTGGATGGTA | 39 | 586 |
| 750519 | 3491034 | 3491224 | GTCATCACCTCTCTTCAGGA | 17 | 181 |
| 1065269 | 432253 | 432272 | TCATCATCAACCTAACCGAG | 92 | 880 |
| 1065285 | 433960 | 433979 | CCATCTTGGAACCGGATGAC | 65 | 881 |
| 1065301 | 442413 | 442432 | GTAATTGAGGTGGCCATATC | 101 | 882 |
| 1065317 | 443132 | 443151 | GAGTCCTAAATGTCTCATAC | 81 | 883 |
| 1065333 | 444649 | 444668 | GGTTTTAGTCCACTGGTTCA | 44 | 884 |
| 1065349 | 445540 | 445559 | CTAGTCATGTATCTACAGCC | 88 | 885 |
| 1065365 | 446609 | 446628 | GTATATGGCTTACACAGGCT | 82 | 886 |
| 1065381 | 447599 | 447618 | GAGATTTCAGACTACCTGTA | 64 | 887 |
| 1065397 | 448125 | 448144 | ATTGACCCAGCCCATGGCAC | 97 | 888 |
| 1065413 | 448713 | 448732 | GCGCATTGAGCAAAATTCCA | 73 | 889 |
| 1065429 | 449066 | 449085 | GCATAACGATAATCATGTGG | 116 | 890 |
| 1065445 | 449627 | 449646 | GGCTATAGGCCATTTATTCA | 111 | 891 |
| 1065461 | 451295 | 451314 | TTGAATAACTACCTAGGCTC | 86 | 892 |
| 1065477 | 452310 | 452329 | CCGGTGCAGGAATCCAGGAT | 98 | 893 |
| 1065493 | 453797 | 453816 | TAACAATAAGATAAAGGCGC | 123 | 894 |
| 1065509 | 454580 | 454599 | GGCAAGCAAAGACTACACCG | 55 | 895 |
| 1065525 | 455169 | 455188 | GCTCCTAACATTGTATCCCC | 94 | 896 |
| 1065541 | 455476 | 455495 | CTCTACCAAGCTATCCAAGT | 78 | 897 |
| 1065557 | 456768 | 456787 | GTCCTATTGGAGGGCCGCAC | 39 | 898 |
| 1065573 | 457320 | 457339 | GTCCTCCAATAAGCTTCTGA | 48 | 899 |
| 1065589 | 458165 | 458184 | GGGACAATACTGCAATCCTT | 63 | 900 |
| 1065605 | 458957 | 458976 | AGAGACCTCAAGACCTATAG | 15 | 901 |
| 1065621 | 460348 | 460367 | GACTACTTCAACCTGATACC | 30 | 902 |

TABLE 14-continued

Reduction of UBE3A-ATS RNA by 7,000 nM 5-10-5 MOE gapmers with mixed PO/PS internucleoside linkages in vitro (37,000 cells/well)

| Compound Number | SEQ ID NO: 1 Start Site | SEQ ID NO: 1 Stop Site | Sequence (5' to 3') | UBE3A-ATS (% UTC) | SEQ ID NO |
|---|---|---|---|---|---|
| 1065637 | 460957 | 460976 | GGGCATCATTAACATAAGCT | 69 | 903 |
| 1065652 | 461602 | 461621 | ACAAACGGGCTATGTGAGAT | 50 | 904 |
| 1065667 | 463052 | 463071 | CACTGAGTTTTGTAGTTCG | 32 | 905 |
| 1065682 | 463885 | 463904 | GGCAGTTGTGATAGTCAACA | 75 | 906 |
| 1065698 | 464994 | 465013 | TAGAGGCCCTCTTGTTTCAA | 44 | 907 |
| 1065713 | 465247 | 465266 | GGATTTTATTGGTCATCTCG | 30 | 908 |
| 1065729 | 465664 | 465683 | GTAGTTACTTATACTGGTTC | 62 | 909 |
| 1065745 | 466276 | 466295 | GTGGGTTCCTGATGGAGTCC | 79 | 910 |
| 1065761 | 466540 | 466559 | CTAGGTTGCATAAAGCCAGG | 64 | 911 |
| 1065777 | 467942 | 467961 | GCCTTAAAAGGGTTCCCTGT | 64 | 912 |
| 1065793 | 470287 | 470306 | GGTCATGATGTATGCCATTA | 39 | 913 |
| 1065809 | 474125 | 474144 | ATCTAGCTTGAATGGATACC | 55 | 914 |
| 1065825 | 475454 | 475473 | GTTCTTTCTCGGTCAAACTA | 41 | 915 |
| 1065841 | 476084 | 476103 | TACGAGTTGCTGGTTTCAGC | 46 | 916 |
| 1065857 | 478470 | 478489 | GGTTAGGGCTATGTTATGTT | 31 | 917 |
| 1065873 | 480382 | 480401 | GATTCCACTTGTGTATGCAC | 33 | 918 |
| 1065889 | 482148 | 482167 | CATATACTAAATGTTGCCGA | 30 | 919 |
| 1065905 | 483368 | 483387 | ATACAGAATTCAATGGACCC | 55 | 920 |
| 1065936 | 485657 | 485676 | GCCTAGGACCAGTTGGTTCA | 48 | 921 |
| 1065952 | 487409 | 487428 | GGCTGTTGTACATTCCTAGT | 65 | 922 |
| 1065968 | 489096 | 489115 | CCCTAAGCTTAGATATACCC | 88 | 923 |
| 1065984 | 489740 | 489759 | AGGTGGGAAACCGGTTCCCA | 100 | 924 |
| 1066000 | 493977 | 493996 | GGTCGGTCCCCACCAAAGGA | 58 | 925 |
| 1066016 | 496817 | 496836 | GCCATGTACGACCCTCATCA | 76 | 926 |
| 1066032 | 498218 | 498237 | TACTATAATACGGGACCTCA | 70 | 927 |
| 1066048 | 499683 | 499702 | ATCACATTCAAGGTAGCCCC | 48 | 928 |
| 1066064 | 500605 | 500624 | TGACCAGCAATAGGCTCTGC | 37 | 929 |
| 1066080 | 500895 | 500914 | ACTGGCCTTTGGGTCGGATA | 81 | 930 |
| 1066096 | 501395 | 501414 | GGAGTCCCCAGATAATGCAT | 91 | 931 |
| 1066112 | 501767 | 501786 | GGATGGGCTAAGAGTCACCT | 74 | 932 |
| 1066128 | 502370 | 502389 | GGTATTAAGGCCCTTGGCCA | 104 | 933 |
| 1066144 | 502741 | 502760 | GGCCCGATGACACCAGCCAC | 87 | 934 |
| 1066160 | 502949 | 502968 | TAACAGTCCTGTAACCAGAC | 90 | 935 |
| 1066176 | 503331 | 503350 | CCCCCTGAGATCCATGAGGT | 125 | 936 |
| 1066192 | 503867 | 503886 | CAGTTGTGCAGTTGTTAACT | 86 | 937 |
| 1066208 | 504141 | 504160 | AACCAGATGGCTGAGCTATT | 89 | 938 |

TABLE 14-continued

Reduction of UBE3A-ATS RNA by 7,000 nM 5-10-5 MOE gapmers with mixed PO/PS internucleoside linkages in vitro (37,000 cells/well)

| Compound Number | SEQ ID NO: 1 Start Site | SEQ ID NO: 1 Stop Site | Sequence (5' to 3') | UBE3A-ATS (% UTC) | SEQ ID NO |
|---|---|---|---|---|---|
| 1066224 | 504518 | 504537 | TTAGGCCATACCTCTTCCAT | 77 | 939 |
| 1066240 | 505065 | 505084 | TTAGTCTGTTGTGTGACTCC | 73 | 940 |
| 1066256 | 505644 | 505663 | CCACCTAAGAGCTATCCGCT | 75 | 941 |
| 1066272 | 505945 | 505964 | GGCCGACCAGCTCTGAAAGT | 120 | 942 |
| 1066288 | 506275 | 506294 | ACCAGGGTGGTATTATAAAG | 102 | 943 |
| 1066304 | 506773 | 506792 | CAGGTTGTGGAGGTTGTTCC | 96 | 944 |
| 1066320 | 507371 | 507390 | GTTGTCTGGCATGGAGATCC | 60 | 945 |
| 1066336 | 507929 | 507948 | GTTGATTGGAGGCACTGCAG | 62 | 946 |
| 1066352 | 508488 | 508507 | TGGTGAGTAAATCAATCACG | 106 | 947 |
| 1066368 | 509007 | 509026 | CCCTTCAACATGTGTTAACG | 62 | 948 |
| 1066384 | 509917 | 509936 | CGTGGCTGTACCTGCAGTGC | 49 | 949 |
| 1066400 | 510393 | 510412 | GACTCTGATTGATTCAGTGC | 93 | 950 |
| 1066416 | 510817 | 510836 | AGTACAAACCACTAAGGGTA | 114 | 951 |
| 1066432 | 511629 | 511648 | GTGCCATATAATGTTGAAGC | 71 | 952 |
| 1066448 | 511804 | 511823 | CGTGTCTGAACTGGCCTGTG | 75 | 953 |

TABLE 15

Reduction of UBE3A-ATS RNA by 7,000 nM 5-10-5 MOE gapmers with mixed PO/PS internucleoside linkages in vitro (37,000 cells/well)

| Compound Number | SEQ ID NO: 1 Start Site | SEQ ID NO: 1 Stop Site | Sequence (5' to 3') | UBE3A-ATS (% UTC) | SEQ ID NO |
|---|---|---|---|---|---|
| 617557 | 483977 | 483996 | ATCATGTGCATACCCAGGGT | 28 | 172 |
| 749882 | 460115 | 460134 | ACTTTATAGTGTGGATGGTA | 25 | 586 |
| 750519 | 349103# | 349122# | GTCATCACCTCTCTTCAGGA | 17 | 181 |
| 1065270 | 432284 | 432303 | CATAACCTCTCCTCGAGACA | 96 | 954 |
| 1065286 | 434182 | 434201 | TCTGTCACGCTTCCCTTGGC | 61 | 955 |
| 1065302 | 442470 | 442489 | TCACTGGTGTGGTATCATGC | 49 | 956 |
| 1065318 | 443199 | 443218 | GATTGCATCTCTTGCAGCAC | 63 | 957 |
| 1065334 | 444722 | 444741 | CTCACCTGTGTATATGAGTC | 93 | 958 |
| 1065350 | 445583 | 445602 | ACACTGTTAGAGCCCCCACA | 71 | 959 |
| 1065366 | 446657 | 446676 | GCATAGGAATGGGACCATAG | 88 | 960 |
| 1065382 | 447672 | 447691 | GCATCATACATAGTGTATGC | 80 | 961 |
| 1065398 | 448219 | 448238 | CTTGTCTCACAATTGTTACC | 83 | 962 |
| 1065414 | 448721 | 448740 | TAACTGTAGCGCATTGAGCA | 91 | 963 |
| 1065430 | 449092 | 449111 | GCTAGTCACTCATTGAGAAG | 110 | 964 |
| 1065446 | 449633 | 449652 | TAGATAGGCTATAGGCCATT | 85 | 965 |

TABLE 15-continued

Reduction of UBE3A-ATS RNA by 7,000 nM 5-10-5 MOE gapmers with mixed PO/PS internucleoside linkages in vitro (37,000 cells/well)

| Compound Number | SEQ ID NO: 1 Start Site | SEQ ID NO: 1 Stop Site | Sequence (5' to 3') | UBE3A-ATS (% UTC) | SEQ ID NO |
|---|---|---|---|---|---|
| 1065462 | 451694 | 451713 | GCATATATCTTAACTCACCC | 56 | 966 |
| 1065478 | 452315 | 452334 | AAAAGCCGGTGCAGGAATCC | 82 | 967 |
| 1065494 | 453918 | 453937 | TAAGTGCCCATGGCATAGTC | 65 | 968 |
| 1065510 | 454719 | 454738 | GAGTGCTGAAGAACATCCCC | 75 | 969 |
| 1065526 | 455213 | 455232 | CAAGTCTACTACCAATAAGT | 89 | 970 |
| 1065542 | 455567 | 455586 | CGTCAGCATTGCTTGATCTC | 89 | 971 |
| 1065558 | 456773 | 456792 | TATTTGTCCTATTGGAGGGC | ND | 972 |
| 1065574 | 457363 | 457382 | CATGGTGAGGGTCTCAATGA | 40 | 973 |
| 1065590 | 458238 | 458257 | GAGACATGTGCCAGTTCAAG | 19 | 974 |
| 1065606 | 458987 | 459006 | GGACACTGGCACATCTATAG | 64 | 975 |
| 1065622 | 460362 | 460381 | CTGTATAACTGATTGACTAC | 51 | 976 |
| 1065638 | 461068 | 461087 | GCTCATCTATGGATTGCATT | 49 | 977 |
| 1065653 | 461604 | 461623 | GTACAAACGGGCTATGTGAG | 30 | 978 |
| 1065668 | 463144 | 463163 | AGCTATAGGTACCTGAAGTT | 49 | 979 |
| 1065683 | 464365 | 464384 | CTTAGCTTGCCCAGAGCATA | 57 | 980 |
| 1065699 | 464999 | 465018 | GCGAATAGAGGCCCTCTTGT | 49 | 981 |
| 1065714 | 465287 | 465306 | GATGTGTATAGGTGTTGGTC | 55 | 982 |
| 1065730 | 465808 | 465827 | CCATTTTGGTGCTATAACCC | 43 | 983 |
| 1065746 | 466283 | 466302 | CTTATAGGTGGGTTCCTGAT | 40 | 984 |
| 1065762 | 466543 | 466562 | TCTCTAGGTTGCATAAAGCC | 69 | 985 |
| 1065778 | 468007 | 468026 | GCACTTGTATAGTTCATCCC | 37 | 986 |
| 1065794 | 470316 | 470335 | ATCCTGCATCCGAGGCATGA | 76 | 987 |
| 1065810 | 474167 | 474186 | GTGGTTGCCTTAGTATTACA | 24 | 988 |
| 1065826 | 475512 | 475531 | CTGTAAGGTGATATCTATAC | 28 | 989 |
| 1065842 | 476090 | 476109 | TGTTCATACGAGTTGCTGGT | 52 | 990 |
| 1065858 | 478533 | 478552 | CGCAATGTATCAGGCAACAG | 29 | 991 |
| 1065874 | 480393 | 480412 | GAGGGCACAATGATTCCACT | 65 | 992 |
| 1065890 | 482162 | 482181 | GGAGTTACAAGTGTCATATA | 37 | 993 |
| 1065906 | 483424 | 483443 | GGCTCTATGCACTTAAGGGA | 42 | 994 |
| 1065921 | 483978 | 483997 | GATCATGTGCATACCCAGGG | 35 | 995 |
| 1065937 | 485769 | 485788 | GGTCAGATTCCTAAATACGC | 26 | 996 |
| 1065953 | 487600 | 487619 | GTGTCATATGTAGCAATTAG | 25 | 997 |
| 1065969 | 489319 | 489338 | CACCTGTATAGGAGAATTGT | 100 | 998 |
| 1065985 | 489776 | 489795 | CCACTCCCGTGGCAACATGA | 85 | 999 |
| 1066001 | 493985 | 494004 | GGGTAAGAGGTCGGTCCCCA | 48 | 1000 |
| 1066017 | 496821 | 496840 | GGAGGCCATGTACGACCCTC | 80 | 1001 |

TABLE 15-continued

Reduction of UBE3A-ATS RNA by 7,000 nM 5-10-5 MOE gapmers with mixed PO/PS internucleoside linkages in vitro (37,000 cells/well)

| Compound Number | SEQ ID NO: 1 Start Site | SEQ ID NO: 1 Stop Site | Sequence (5' to 3') | UBE3A-ATS (% UTC) | SEQ ID NO |
|---|---|---|---|---|---|
| 1066033 | 498225 | 498244 | GCTGCAATACTATAATACGG | 56 | 1002 |
| 1066049 | 499792 | 499811 | AGCTGAGGTCACCGATCAGA | 83 | 1003 |
| 1066065 | 500610 | 500629 | AACAGTGACCAGCAATAGGC | 64 | 1004 |
| 1066081 | 500898 | 500917 | CTAACTGGCCTTTGGGTCGG | 107 | 1005 |
| 1066097 | 501399 | 501418 | GGGAGGAGTCCCCAGATAAT | 24 | 1006 |
| 1066113 | 501802 | 501821 | GGCCCAAGTGATGACATATC | 50 | 1007 |
| 1066129 | 502410 | 502429 | GTAAGGCATGGTCTTCCTTG | 79 | 1008 |
| 1066145 | 502746 | 502765 | AATATGGCCCGATGACACCA | 85 | 1009 |
| 1066161 | 502956 | 502975 | GCAAGATTAACAGTCCTGTA | 53 | 1010 |
| 1066177 | 503342 | 503361 | TCAGCTCAACACCCCCTGAG | 96 | 1011 |
| 1066193 | 503872 | 503891 | AGGGTCAGTTGTGCAGTTGT | 39 | 1012 |
| 1066209 | 504260 | 504279 | GCAAGGAATCATGTGGCTCC | 70 | 1013 |
| 1066225 | 504526 | 504545 | CCAAAGATTTAGGCCATACC | 55 | 1014 |
| 1066241 | 505106 | 505125 | GTAACCTTCACATAAGCTGC | 48 | 1015 |
| 1066257 | 505654 | 505673 | GGCCTAGCTTCCACCTAAGA | 104 | 1016 |
| 1066273 | 505949 | 505968 | CGCTGGCCGACCAGCTCTGA | ND | 1017 |
| 1066289 | 506280 | 506299 | CGTCTACCAGGGTGGTATTA | 41 | 1018 |
| 1066305 | 506779 | 506798 | ATACTCCAGGTTGTGGAGGT | 84 | 1019 |
| 1066321 | 507481 | 507500 | CAAATTGGTGAATGTTCCCC | 44 | 1020 |
| 1066337 | 508000 | 508019 | TCTCATGACCACCTAATTGA | 72 | 1021 |
| 1066353 | 508571 | 508590 | CCGTGCTGCTTTCTTGAGTG | 92 | 1022 |
| 1066369 | 509052 | 509071 | ACATGCTTGCATCCAGGCCC | 53 | 1023 |
| 1066385 | 510017 | 510036 | CGGAACCCACAGTAGAGGCA | 46 | 1024 |
| 1066401 | 510398 | 510417 | CTAGGGACTCTGATTGATTC | 45 | 1025 |
| 1066417 | 510827 | 510846 | ACCAGGCATAAGTACAAACC | 62 | 1026 |
| 1066433 | 511633 | 511652 | CTGAGTGCCATATAATGTTG | 71 | 1027 |
| 1066449 | 511822 | 511841 | AAGGCTCTCAGGGTAAGACG | 42 | 1028 |

TABLE 16

Reduction of UBE3A-ATS RNA by 7,000 nM 5-10-5 MOE gapmers with mixed PO/PS internucleoside linkages in vitro (37,000 cells/well)

| Compound Number | SEQ ID NO: 1 Start Site | SEQ ID NO: 1 Stop Site | Sequence (5' to 3') | UBE3A-ATS (% UTC) | SEQ ID NO |
|---|---|---|---|---|---|
| 617557 | 483977 | 483996 | ATCATGTGCATACCCAGGGT | 52 | 172 |
| 749882 | 460115 | 460134 | ACTTTATAGTGTGGATGGTA | 22 | 586 |
| 750519 | 349103# | 349122# | GTCATCACCTCTCTTCAGGA | 12 | 181 |

TABLE 16 -continued

Reduction of UBE3A-ATS RNA by 7,000 nM 5-10-5 MOE gapmers with mixed PO/PS internucleoside linkages in vitro (37,000 cells/well)

| Compound Number | SEQ ID NO: 1 Start Site | SEQ ID NO: 1 Stop Site | Sequence (5' to 3') | UBE3A-ATS (% UTC) | SEQ ID NO |
|---|---|---|---|---|---|
| 1065259 | 430439 | 430458 | CGTGGAACACTGACCCATCA | 73 | 1029 |
| 1065275 | 432915 | 432934 | CAGCATGTAACTCATGTTGT | 75 | 1030 |
| 1065291 | 441514 | 441533 | GTTCTAAAGTCGGTTGTGTC | 57 | 1031 |
| 1065307 | 442648 | 442667 | AGAGTAGGCCAGGTGTCAAA | 60 | 1032 |
| 1065323 | 443577 | 443596 | TACCAGTGAGTAAACTGGCC | 89 | 1033 |
| 1065339 | 444914 | 444933 | GTACTCCCCATGCACACTTG | 48 | 1034 |
| 1065355 | 445958 | 445977 | ACGGATTATCATACCCTCCC | 115 | 1035 |
| 1065371 | 446805 | 446824 | GTCTTGTAAACCCTTACCAG | 83 | 1036 |
| 1065387 | 447818 | 447837 | CCGTTACTTAAGCTGTGGTA | 88 | 1037 |
| 1065403 | 448458 | 448477 | TAGTGCCAGTAGGACTTACT | 75 | 1038 |
| 1065419 | 448827 | 448846 | GGACCCTTAAGTCATAAAGA | 78 | 1039 |
| 1065435 | 449209 | 449228 | GACCAAATGAGCATCACATC | 69 | 1040 |
| 1065451 | 449704 | 449723 | CCTGTATGTATGGCTTATGC | 73 | 1041 |
| 1065467 | 452181 | 452200 | ATCCATAGTGATCTGGGAAC | 77 | 1042 |
| 1065483 | 453133 | 453152 | ACTATAATTGGGAATGGTCA | 77 | 1043 |
| 1065499 | 454160 | 454179 | GATTTGACCCTTATGGAGAC | 104 | 1044 |
| 1065515 | 454855 | 454874 | TATTCCCTATCCAGGGTAGA | 96 | 1045 |
| 1065531 | 455296 | 455315 | TTATCCTGTTGCAATAGAAC | 81 | 1046 |
| 1065547 | 456499 | 456518 | ATTAGATTAAAATCTGGCCG | 93 | 1047 |
| 1065563 | 456886 | 456905 | GACTCATAAGACAGGATGCC | 87 | 1048 |
| 1065579 | 457738 | 457757 | CCAGCCAGGTGTCTTATATC | 18 | 1049 |
| 1065595 | 458523 | 458542 | CAGTTGTGTATTGACTAAGT | 23 | 1050 |
| 1065611 | 459549 | 459568 | AAGACTATCCTGGTATGACT | 56 | 1051 |
| 1065627 | 460624 | 460643 | TCGATGTTCTTGCTTCCCTG | 32 | 1052 |
| 1065642 | 461446 | 461465 | GGCAGCTCCTGACAAATTAG | 22 | 1053 |
| 1065658 | 461694 | 461713 | AGACCCTCCCTTAATGTAA | 53 | 1054 |
| 1065673 | 463249 | 463268 | ACCTGGGTATTGCTGTCCAA | 41 | 1055 |
| 1065688 | 464458 | 464477 | CTCACCCTTTACTAAGGTGC | 75 | 1056 |
| 1065703 | 465140 | 465159 | CCATTGGTATGAGAGATGCT | 72 | 1057 |
| 1065719 | 465386 | 465405 | GTCAGACTTATTGAGGATGG | 27 | 1058 |
| 1065735 | 465932 | 465951 | TTACTCCTCTGGTGTGCTGA | 29 | 1059 |
| 1065751 | 466372 | 466391 | GCGCACTTGGGAGCCAGCCA | 68 | 1060 |
| 1065767 | 467076 | 467095 | TTACTGACTGGCCTTAGGAG | 38 | 1061 |
| 1065783 | 468351 | 468370 | GTAGTATGCATTGACAAGCT | 32 | 1062 |
| 1065799 | 471923 | 471942 | GAGTATATTACCTCCAGGTT | 27 | 1063 |
| 1065815 | 474614 | 474633 | GTATTGCTGCTCTAGCTCTA | 49 | 1064 |

TABLE 16 -continued

Reduction of UBE3A-ATS RNA by 7,000 nM 5-10-5 MOE gapmers with mixed PO/PS internucleoside linkages in vitro (37,000 cells/well)

| Compound Number | SEQ ID NO: 1 Start Site | SEQ ID NO: 1 Stop Site | Sequence (5' to 3') | UBE3A-ATS (% UTC) | SEQ ID NO |
|---|---|---|---|---|---|
| 1065831 | 475841 | 475860 | ACGGACCTCATACAGTGAGT | 31 | 1065 |
| 1065847 | 476213 | 476232 | GGGCTCTTGGAAGTCTAGTT | 59 | 1066 |
| 1065863 | 479124 | 479143 | ACATACTTGGTTGCAGACGC | 26 | 1067 |
| 1065879 | 480825 | 480844 | TAGGTTTGCGGATGCCAGTG | 50 | 1068 |
| 1065895 | 482771 | 482790 | TACACAGTGGGATTTGCCCC | 59 | 1069 |
| 1065911 | 483853 | 483872 | ATGGCCTGACTAGGCATTGA | 76 | 1070 |
| 1065926 | 484302 | 484321 | GGTTACTAGGGCCAGAGAAT | 42 | 1071 |
| 1065942 | 486355 | 486374 | TGTTAATAGACTGCGATTAT | 56 | 1072 |
| 1065958 | 487839 | 487858 | GGGCGGAGCTGCATAGGAGT | 51 | 1073 |
| 1065974 | 489522 | 489541 | ACAATGGACCACCTAAGACC | 96 | 1074 |
| 1065990 | 489953 | 489972 | CAACCCTTACTCTGCCAGGG | 80 | 1075 |
| 1066006 | 494491 | 494510 | TGTGCAATAGCCTAAATGCC | 82 | 1076 |
| 1066022 | 497436 | 497455 | CTACTATGAAGTTATGCACC | 69 | 1077 |
| 1066038 | 499100 | 499119 | GTTAGCCTTACAGCAAATAC | 52 | 1078 |
| 1066054 | 500359 | 500378 | TACTAATTAGCAAGCCACTG | 52 | 1079 |
| 1066070 | 500766 | 500785 | GTGTCAAATCAATTTGTGCC | 47 | 1080 |
| 1066086 | 501001 | 501020 | CTAAGCACATCCGATAGTCA | 49 | 1081 |
| 1066102 | 501563 | 501582 | GGAGTGCTCTTTGTGGATGC | 39 | 1082 |
| 1066118 | 502117 | 502136 | ACCCATGGCTCATCAGTGGG | 91 | 1083 |
| 1066134 | 502447 | 502466 | GGCAGCTCTTTGTAGGCCCA | 60 | 1084 |
| 1066150 | 502782 | 502801 | GGAGTGGGTTCCTATAAGGA | 53 | 1085 |
| 1066166 | 503100 | 503119 | GGACTAATAGGCCTTTCTAC | 61 | 1086 |
| 1066182 | 503399 | 503418 | CTACAGTACCAGGTCATTTG | 45 | 1087 |
| 1066198 | 503946 | 503965 | CACCACCAACCTTAAATAGT | 80 | 1088 |
| 1066214 | 504395 | 504414 | CCATGCCACAGATTGGCTTG | 64 | 1089 |
| 1066230 | 504654 | 504673 | CGGAGCCTTACGCTTGGCTG | 66 | 1090 |
| 1066246 | 505185 | 505204 | CAGTCTGTCTCTGTGTACCG | 46 | 1091 |
| 1066262 | 505741 | 505760 | GGTTGACAGGACATGCTGTC | 58 | 1092 |
| 1066278 | 506119 | 506138 | GTTAGCCGAGCATTGGCTTC | 84 | 1093 |
| 1066294 | 506589 | 506608 | CCCATGGTGGTGGAATGCTG | 102 | 1094 |
| 1066310 | 506992 | 507011 | TCCCGCACCATGCATTCTGA | 43 | 1095 |
| 1066326 | 507684 | 507703 | TCAGCTTCCTTCAGTGGGCG | 65 | 1096 |
| 1066342 | 508193 | 508212 | GATCTCACACATGGCACTGC | 71 | 1097 |
| 1066358 | 508691 | 508710 | TACCAGTAAAGGGTAGTATA | 49 | 1098 |
| 1066374 | 509110 | 509129 | GTAAATATACACTTGGGCCC | 73 | 1099 |
| 1066390 | 510117 | 510136 | TAGCTGAACCTGTGGCTAGG | 60 | 1100 |

TABLE 16 -continued

Reduction of UBE3A-ATS RNA by 7,000 nM 5-10-5 MOE gapmers with mixed PO/PS internucleoside linkages in vitro (37,000 cells/well)

| Compound Number | SEQ ID NO: 1 Start Site | SEQ ID NO: 1 Stop Site | Sequence (5' to 3') | UBE3A-ATS (% UTC) | SEQ ID NO |
|---|---|---|---|---|---|
| 1066406 | 510654 | 510673 | AGTGTCAGGCTGTAAGGGAT | 59 | 1101 |
| 1066422 | 510901 | 510920 | GCCATAGGTTTCAGGCTGAT | 46 | 1102 |
| 1066438 | 511707 | 511726 | GAGATGGGCTATGAGCCATC | 84 | 1103 |

TABLE 17

Reduction of UBE3A-ATS RNA by 7,000 nM 5-10-5 MOE gapmers with mixed PO/PS internucleoside linkages in vitro (37,000 cells/well)

| Compound Number | SEQ ID NO: 1 Start Site | SEQ ID NO: 1 Stop Site | Sequence (5' to 3') | UBE3A-ATS (% UTC) | SEQ ID NO |
|---|---|---|---|---|---|
| 617557 | 483977 | 483996 | ATCATGTGCATACCCAGGGT | 32 | 172 |
| 749882 | 460115 | 460134 | ACTTTATAGTGTGGATGGTA | 21 | 586 |
| 750519 | 349103# | 349122# | GTCATCACCTCTCTTCAGGA | 8 | 181 |
| 1065264 | 430601 | 430620 | GGACCAGCGGGCCGAACGCA | 101 | 1104 |
| 1065280 | 433410 | 433429 | ATGCAAAGGTGTCGATTTGT | 47 | 1105 |
| 1065296 | 441815 | 441834 | GGTCCATAGATGTCAGTTAC | 27 | 1106 |
| 1065312 | 442767 | 442786 | ATTAATGTTCTATGGTGGAT | 46 | 1107 |
| 1065328 | 443839 | 443858 | GGAGTAGAATGCCCACTGGG | 53 | 1108 |
| 1065344 | 445212 | 445231 | GAGACCTGAATATACCTTAC | 55 | 1109 |
| 1065360 | 446498 | 446517 | GGTATGCCAGGTTTTTGACA | 49 | 1110 |
| 1065376 | 447152 | 447171 | CCGTGTAATGACACACCTCT | 67 | 1111 |
| 1065392 | 447922 | 447941 | AGGCTATAGTCAAAGGGTGG | 46 | 1112 |
| 1065408 | 448614 | 448633 | GTGTCAGTCAATCATTGAGA | 75 | 1113 |
| 1065424 | 449001 | 449020 | GGTCTTATTTACCATTGGCA | 63 | 1114 |
| 1065440 | 449470 | 449489 | TAACATGTTGCTTGCACTCC | 85 | 1115 |
| 1065456 | 450017 | 450036 | GCTCAAACTAGAATACCCCA | 81 | 1116 |
| 1065472 | 452261 | 452280 | GTCTAGGTCTCACGCTGTGT | 96 | 1117 |
| 1065488 | 453235 | 453254 | GACAGTGGAGTCAAGTTGGT | 106 | 1118 |
| 1065504 | 454462 | 454481 | GGACTCCACACACCTACTAG | 107 | 1119 |
| 1065520 | 455019 | 455038 | GTGGGATGGCTGTCAATGCT | 56 | 1120 |
| 1065536 | 455341 | 455360 | GATAATTGAGGAGTTCACCA | 81 | 1121 |
| 1065552 | 220313 456682 | 220332 456701 | GATCCAAACAAGCACCCTCC | 85 | 1122 |
| 1065568 | 457020 | 457039 | TATCACAGTTGCTTGACCCT | 70 | 1123 |
| 1065584 | 457982 | 458001 | GATCTATTATGAGGGCATCA | 39 | 1124 |
| 1065600 | 458571 | 458590 | AGCTTTAGTATGTCGAGAAC | 20 | 1125 |
| 1065616 | 460107 | 460126 | GTGTGGATGGTATCCTGGTC | 26 | 1126 |

TABLE 17 -continued

Reduction of UBE3A-ATS RNA by 7,000 nM 5-10-5 MOE gapmers with mixed PO/PS internucleoside linkages in vitro (37,000 cells/well)

| Compound Number | SEQ ID NO: 1 Start Site | SEQ ID NO: 1 Stop Site | Sequence (5' to 3') | UBE3A-ATS (% UTC) | SEQ ID NO |
|---|---|---|---|---|---|
| 1065632 | 460711 | 460730 | GGAATGCTTGATCTGTGGGC | 25* | 1127 |
| 1065647 | 461518 | 461537 | GCTAGACTAGTTGAAATCGG | 44 | 1128 |
| 1065663 | 462056 | 462075 | CCCTCCCATCAGTGAAGATT | 78 | 1129 |
| 1065677 | 463767 | 463786 | GCTTTAGAGGTCAAATAGTG | 50 | 1130 |
| 1065693 | 464784 | 464803 | CTGGTCTTCCTCGAGGATAG | 69 | 1131 |
| 1065708 | 465236 | 465255 | GTCATCTCGGGTATATAAAT | 30 | 1132 |
| 1065724 | 465561 | 465580 | GGACAAGTCTTATAGAGAAC | 52 | 1133 |
| 1065740 | 466229 | 466248 | GTTCCAAGTATGGGCTGCTG | 44 | 1134 |
| 1065756 | 466426 | 466445 | GTCAACATGTGCTTGCAAGC | 35 | 1135 |
| 1065772 | 467425 | 467444 | GCTGTTGATACGCTCCTTCA | 37 | 1136 |
| 1065788 | 469130 | 469149 | GAGGCACTGAAGTTCACTAC | 37 | 1137 |
| 1065804 | 472937 | 472956 | AGGGTCCCACTTGTTTAGGT | 44 | 1138 |
| 1065820 | 474883 | 474902 | CGTATTAAGGTGTTGTATGA | 40 | 1139 |
| 1065836 | 475943 | 475962 | CCTTGTGACAATAGTAGTGA | 54 | 1140 |
| 1065852 | 476443 | 476462 | GGCTAGATGGAGCTTGAGCC | 94 | 1141 |
| 1065868 | 479997 | 480016 | CGTGAGCTATCTGTACAAAA | 24 | 1142 |
| 1065884 | 481441 | 481460 | GTGCATAATGGTCTACCACA | 32 | 1143 |
| 1065900 | 482857 | 482876 | TGAAGATAGGTCAGTTAACG | 58 | 1144 |
| 1065916 | 483925 | 483944 | GTTAAGCTTTCACCTATAGG | 33 | 1145 |
| 1065931 | 484601 | 484620 | TGATCATATGGGTGGTCGCT | 46 | 1146 |
| 1065947 | 487134 | 487153 | ATTGTCCTCCTGGTAACCAC | 28 | 1147 |
| 1065963 | 488572 | 488591 | GGGACTGGTGCCACACCATC | 55 | 1148 |
| 1065979 | 489629 | 489648 | CTAACCTGGATCTCAGATAG | 75 | 1149 |
| 1065995 | 493844 | 493863 | CTGGGCCCCAATTCAGTAAT | 98 | 1150 |
| 1066011 | 495399 | 495418 | TTGGTAAAGGAGGGAATCGG | ND | 1151 |
| 1066027 | 498030 | 498049 | TCCAGGATATATGTTAGTCC | 46 | 1152 |
| 1066043 | 499291 | 499310 | TAGCTACAATAAGTTGTAGC | 94 | 1153 |
| 1066059 | 500494 | 500513 | GAGGGCCATGTTAAAGGCCT | 119 | 1154 |
| 1066075 | 500861 | 500880 | TTTTGGTAGGTAACTACGGG | 41 | 1155 |
| 1066091 | 501335 | 501354 | TGTAGCTCAGCTCAATGTGT | 58 | 1156 |
| 1066107 | 501628 | 501647 | GAACTGCACTGGGTTGTCTC | 58 | 1157 |
| 1066123 | 502162 | 502181 | GTATTGCACTCACATACTGT | 61 | 1158 |
| 1066139 | 502579 | 502598 | AGCCAATGCGCAAGAAAAGT | 69 | 1159 |
| 1066155 | 502824 | 502843 | CATAGGCATAAAGCCTCCTA | 79 | 1160 |
| 1066171 | 503139 | 503158 | TCCCAGAAATGGTCCTCGCA | 86 | 1161 |
| 1066187 | 503480 | 503499 | ATGTGGGTCTGCACCAAGTT | 86 | 1162 |

TABLE 17 -continued

Reduction of UBE3A-ATS RNA by 7,000 nM 5-10-5 MOE gapmers with mixed PO/PS internucleoside linkages in vitro (37,000 cells/well)

| Compound Number | SEQ ID NO: 1 Start Site | SEQ ID NO: 1 Stop Site | Sequence (5' to 3') | UBE3A-ATS (% UTC) | SEQ ID NO |
|---|---|---|---|---|---|
| 1066203 | 504077 | 504096 | GGTGAACTCCTGTGACTGAT | 52 | 1163 |
| 1066219 | 504441 | 504460 | GTGGAGTAGGTATATTAGTC | 32 | 1164 |
| 1066235 | 504825 | 504844 | GTATTCCTGAAGTAGTCCTG | 36 | 1165 |
| 1066251 | 505330 | 505349 | AGAAATTGGGCCGCCTCTGT | 58 | 1166 |
| 1066267 | 505817 | 505836 | GTGCTTAGTGAACTGTGGGC | 55 | 1167 |
| 1066283 | 506185 | 506204 | CCGGCATGCATCAGCTCTGA | 34 | 1168 |
| 1066299 | 506693 | 506712 | TAAGAAGCTTGCCTTTCGAT | 96 | 1169 |
| 1066315 | 507250 | 507269 | GCAGTGCTACTGTGCCCTTA | 58 | 1170 |
| 1066331 | 507818 | 507837 | TCCAGCCCTCAGTATATAGA | 62 | 1171 |
| 1066347 | 508285 | 508304 | CCGAAGTGGAAGTAGTCATG | 63 | 1172 |
| 1066363 | 508790 | 508809 | TGAATGCCACCGTGATTGCA | 50 | 1173 |
| 1066379 | 509416 | 509435 | CGTAGTGTCATCACCATAAA | 45 | 1174 |
| 1066395 | 510227 | 510246 | GTTGTGTCTGAGGGATATCC | 45 | 1175 |
| 1066411 | 510718 | 510737 | GCCGAATCTTGACATACAGG | 55 | 1176 |
| 1066427 | 511241 | 511260 | GATTACCAAAAAGGGACCAG | 48 | 1177 |
| 1066443 | 511766 | 511785 | CTCCTACCAATAATGGAGTC | 76 | 1178 |

TABLE 18

Reduction of UBE3A-ATS RNA by 7,000 nM 5-10-5 MOE gapmers with mixed PO/PS internucleoside linkages in vitro (37,000 cells/well)

| Compound Number | SEQ ID NO: 1 Start Site | SEQ ID NO: 1 Stop Site | Sequence (5' to 3') | UBE3A-ATS (% UTC) | SEQ ID NO |
|---|---|---|---|---|---|
| 617557 | 483977 | 483996 | ATCATGTGCATACCCAGGGT | 38 | 172 |
| 749882 | 460115 | 460134 | ACTTTATAGTGTGGATGGTA | 32 | 586 |
| 750519 | 349103# | 349122# | GTCATCACCTCTCTTCAGGA | 17 | 181 |
| 1065265 | 430612 | 430631 | CGGACACACTGGGACCAGCG | 90 | 1179 |
| 1065281 | 433463 | 433482 | GCTCCTATCAAGCTTTTCCC | 46 | 1180 |
| 1065297 | 441909 | 441928 | TGAGGTGCATTTTCTAGCCC | 78 | 1181 |
| 1065313 | 442830 | 442849 | ATCTATGGAGTCATCTCCCC | 76 | 1182 |
| 1065329 | 443979 | 443998 | GGTAGAGGTTAATCTATGTC | 59 | 1183 |
| 1065345 | 445310 | 445329 | CGTCGGTAAAGGAAGCTACT | 58 | 1184 |
| 1065361 | 446510 | 446529 | TCATAAGGACAAGGTATGCC | 73 | 1185 |
| 1065377 | 447310 | 447329 | GGACCTCATTAGATCAGTCA | 90 | 1186 |
| 1065393 | 448007 | 448026 | GGCAGTTGAGTGGTGTCAGT | 99 | 1187 |
| 1065409 | 448628 | 448647 | GGATTGCATCACATGTGTCA | 55 | 1188 |

TABLE 18-continued

Reduction of UBE3A-ATS RNA by 7,000 nM 5-10-5 MOE gapmers with mixed PO/PS internucleoside linkages in vitro (37,000 cells/well)

| Compound Number | SEQ ID NO: 1 Start Site | SEQ ID NO: 1 Stop Site | Sequence (5' to 3') | UBE3A-ATS (% UTC) | SEQ ID NO |
|---|---|---|---|---|---|
| 1065425 | 449017 | 449036 | TATAAGTGTCCATAAAGGTC | 90 | 1189 |
| 1065441 | 449475 | 449494 | GGCATTAACATGTTGCTTGC | 66 | 1190 |
| 1065457 | 450095 | 450114 | GAATTGATAAGTGGTCTTCT | 86 | 1191 |
| 1065473 | 452266 | 452285 | GGGAAGTCTAGGTCTCACGC | ND | 1192 |
| 1065489 | 453243 | 453262 | CTACATATGACAGTGGAGTC | 89 | 1193 |
| 1065505 | 454467 | 454486 | TGAGTGGACTCCACACACCT | 84 | 1194 |
| 1065521 | 455028 | 455047 | GATATTGCAGTGGGATGGCT | 60 | 1195 |
| 1065537 | 455360 | 455379 | CGTGATAGTGCTATTGTGAG | 60 | 1196 |
| 1065553 | 220317 456686 | 220336 456705 | CATCGATCCAAACAAGCACC | 74 | 1197 |
| 1065569 | 457233 | 457252 | GCTTAGCTACTCACCCCTGT | 70 | 1198 |
| 1065585 | 457989 | 458008 | CCCACTTGATCTATTATGAG | 64 | 1199 |
| 1065601 | 458790 | 458809 | CCCTAATATAGGGCAGATGA | 59 | 1200 |
| 1065617 | 460108 | 460127 | AGTGTGGATGGTATCCTGGT | 44 | 1201 |
| 1065633 | 460736 | 460755 | GGATTTGAGCCTGCTATGTC | 15* | 1202 |
| 1065648 | 461524 | 461543 | CATTCAGCTAGACTAGTTGA | 70 | 1203 |
| 1065664 | 462061 | 462080 | TATGGCCCTCCCATCAGTGA | 49 | 1204 |
| 1065678 | 463775 | 463794 | TAGATTGGGCTTTAGAGGTC | 33 | 1205 |
| 1065694 | 464788 | 464807 | ACATCTGGTCTTCCTCGAGG | 61 | 1206 |
| 1065709 | 465237 | 465256 | GGTCATCTCGGGTATATAAA | 17 | 1207 |
| 1065725 | 465591 | 465610 | ACCGAAGGAGTTCCTTTAGC | 40 | 1208 |
| 1065741 | 466233 | 466252 | GGCAGTTCCAAGTATGGGCT | 76 | 1209 |
| 1065757 | 466438 | 466457 | GTGGAGCCAGCTGTCAACAT | 66 | 1210 |
| 1065773 | 467718 | 467737 | TGGAATGTATCCTGTACGGG | 52 | 1211 |
| 1065789 | 469377 | 469396 | GTGTTATACTATTGTGGTGC | 42 | 1212 |
| 1065805 | 472944 | 472963 | GTTTGTTAGGGTCCCACTTG | 49 | 1213 |
| 1065821 | 474901 | 474920 | TCTGCTATTGTTGGATATCG | 33 | 1214 |
| 1065837 | 475988 | 476007 | ATGGTTAGTTTAAGAAATCG | 65 | 1215 |
| 1065853 | 478295 | 478314 | GAGTCCTGGTTGATGTGGTG | 65 | 1216 |
| 1065869 | 480141 | 480160 | ACGGGCATGCTTTATAATTA | 73 | 1217 |
| 1065885 | 481448 | 481467 | AACCTTTGTGCATAATGGTC | 82 | 1218 |
| 1065901 | 482908 | 482927 | CACTCTATAGGTTCAAGCAG | 37 | 1219 |
| 1065917 | 483964 | 483983 | CCAGGGTAGGATTCATGGTC | 63 | 1220 |
| 1065932 | 484673 | 484692 | TGTTGTATGCAGGTTCATCA | 31 | 1221 |
| 1065948 | 487139 | 487158 | GATACATTGTCCTCCTGGTA | 35 | 1222 |
| 1065964 | 488637 | 488656 | ACACTTGAAGCTGTTGAGTC | 66 | 1223 |
| 1065980 | 489652 | 489671 | CGTGAAGGAATGATCTCTCT | 61 | 1224 |

TABLE 18-continued

Reduction of UBE3A-ATS RNA by 7,000 nM 5-10-5 MOE gapmers with mixed PO/PS internucleoside linkages in vitro (37,000 cells/well)

| Compound Number | SEQ ID NO: 1 Start Site | SEQ ID NO: 1 Stop Site | Sequence (5' to 3') | UBE3A-ATS (% UTC) | SEQ ID NO |
|---|---|---|---|---|---|
| 1065996 | 493855 | 493874 | CCTAATCTATGCTGGGCCCC | 75 | 1225 |
| 1066012 | 495430 | 495449 | GAGAGTAAGTTACTAGAGGC | 59 | 1226 |
| 1066028 | 498180 | 498199 | TGGGCAGATTGATCACCTAG | 93 | 1227 |
| 1066044 | 499495 | 499514 | TACTAGGCCTGCTCTACTGG | 71 | 1228 |
| 1066060 | 500523 | 500542 | TTAGAGGTCAAGCCCTGTGT | 63 | 1229 |
| 1066076 | 500885 | 500904 | GGGTCGGATATAGCTTTTAC | 31 | 1230 |
| 1066092 | 501340 | 501359 | GCTTATGTAGCTCAGCTCAA | 33 | 1231 |
| 1066108 | 501701 | 501720 | TTGGGACATCCCAAAGTTAC | 80 | 1232 |
| 1066124 | 502205 | 502224 | GGAACATCATGTTAGCCATC | 44 | 1233 |
| 1066140 | 502588 | 502607 | GATGCATCAAGCCAATGCGC | 41 | 1234 |
| 1066156 | 502882 | 502901 | GAACCTCTACAGAGAGACTA | 65 | 1235 |
| 1066172 | 503154 | 503173 | GTTCTGTATACACCATCCCA | 56 | 1236 |
| 1066188 | 503485 | 503504 | GCAAAATGTGGGTCTGCACC | 96 | 1237 |
| 1066204 | 504082 | 504101 | TAACTGGTGAACTCCTGTGA | 98 | 1238 |
| 1066220 | 504449 | 504468 | CCCCAGAAGTGGAGTAGGTA | ND | 1239 |
| 1066236 | 504866 | 504885 | CCTCAAGATCAACAGACCCC | 81 | 1240 |
| 1066252 | 505543 | 505562 | CAGTCAGGTACAGGTGTTGG | 52 | 1241 |
| 1066268 | 505823 | 505842 | GTGAGGGTGCTTAGTGAACT | 54 | 1242 |
| 1066284 | 506196 | 506215 | GTCAGAACAATCCGGCATGC | 50 | 1243 |
| 1066300 | 506730 | 506749 | GAGTGCTCCACACTTCTGTC | 65 | 1244 |
| 1066316 | 507254 | 507273 | GCTTGCAGTGCTACTGTGCC | 95 | 1245 |
| 1066332 | 507900 | 507919 | TCGATACCTGCTTTTGTGAC | 69 | 1246 |
| 1066348 | 508290 | 508309 | CATAACCGAAGTGGAAGTAG | 71 | 1247 |
| 1066364 | 508901 | 508920 | TACTTCATGACTGCCTAGTT | 78 | 1248 |
| 1066380 | 509434 | 509453 | AAGAAGGGCATATATCTACG | 72 | 1249 |
| 1066396 | 510312 | 510331 | CGGACAGTGTTGCTGTTAGG | 39 | 1250 |
| 1066412 | 510724 | 510743 | GGTCAAGCCGAATCTTGACA | 68 | 1251 |
| 1066428 | 511490 | 511509 | TGACTGGGTAAGGCAGGATC | 50 | 1252 |
| 1066444 | 511770 | 511789 | AGTACTCCTACCAATAATGG | 77 | 1253 |

TABLE 19

Reduction of UBE3A-ATS RNA by 7,000 nM 5-10-5 MOE gapmers with mixed PO/PS internucleoside linkages in vitro (37,000 cells/well)

| Compound Number | SEQ ID NO: 1 Start Site | SEQ ID NO: 1 Stop Site | Sequence (5' to 3') | UBE3A-ATS (% UTC) | SEQ ID NO |
|---|---|---|---|---|---|
| 617557 | 483977 | 483996 | ATCATGTGCATACCCAGGGT | 17 | 172 |
| 749882 | 460115 | 460134 | ACTTTATAGTGTGGATGGTA | 26 | 586 |
| 750519 | 349103# | 349122# | GTCATCACCTCTCTTCAGGA | 12 | 181 |
| 1065271 | 432577 | 432596 | GGCAGTGCATTCAACTGTAG | 75 | 1254 |
| 1065287 | 440156 | 440175 | CGTGGGTTAGTCCAAGTAAC | 49 | 1255 |
| 1065303 | 442546 | 442565 | GCCCATTATGTAGTCTATAG | 37 | 1256 |
| 1065319 | 443234 | 443253 | GACGAAGGCAGTCACTCTGC | 88 | 1257 |
| 1065335 | 444735 | 444754 | GGGAGAACTACATCTCACCT | 63 | 1258 |
| 1065351 | 445658 | 445677 | CCCCATTACCACGGTCTCTT | 63 | 1259 |
| 1065367 | 446675 | 446694 | AGCAGTCTTTATCTACAGGC | 85 | 1260 |
| 1065383 | 447745 | 447764 | TTGATGACCTGGTAAGGGAT | 76 | 1261 |
| 1065399 | 448290 | 448309 | CGCAATAAGATTCCATTGCC | 83 | 1262 |
| 1065415 | 448725 | 448744 | ACGATAACTGTAGCGCATTG | 70 | 1263 |
| 1065431 | 449100 | 449119 | GCAAGTATGCTAGTCACTCA | 82 | 1264 |
| 1065447 | 449637 | 449656 | CCATTAGATAGGCTATAGGC | 77 | 1265 |
| 1065463 | 452066 | 452085 | TCGCCGCTGATTTTAAAGAT | 97 | 1266 |
| 1065479 | 452320 | 452339 | GGTTCAAAAGCCGGTGCAGG | 83 | 1267 |
| 1065495 | 453926 | 453945 | GTTGTTCTTAAGTGCCCATG | 61 | 1268 |
| 1065511 | 454740 | 454759 | GCACTTTGCATGAGAATAGG | 60 | 1269 |
| 1065527 | 455219 | 455238 | TCCAGACAAGTCTACTACCA | 69 | 1270 |
| 1065543 | 455585 | 455604 | TCTACTCCTTGCTACAAACG | 84 | 1271 |
| 1065575 | 457378 | 457397 | CAATAGTGTAGGTGACATGG | 36 | 1273 |
| 1065591 | 458400 | 458419 | GCATGTGGGCCTCTATTAAG | 8 | 1274 |
| 1065607 | 459079 | 459098 | GTATGGTATCTTGCAGTAGC | 15 | 1275 |
| 1065623 | 460427 | 460446 | ATAGCCCTTTCAGCACACTT | 16 | 1276 |
| 1065639 | 461343 | 461362 | GCTGGCAATATGTCAACCTT | 36 | 1277 |
| 1065654 | 461605 | 461624 | TGTACAAACGGGCTATGTGA | 30 | 1278 |
| 1065669 | 463151 | 463170 | CATATGAAGCTATAGGTACC | 22 | 1279 |
| 1065684 | 464383 | 464402 | GGTAGTTCACAACTCTTCCT | 59 | 1280 |
| 1065700 | 465002 | 465021 | TCTGCGAATAGAGGCCCTCT | 49 | 1281 |
| 1065715 | 465301 | 465320 | GACACGCTGACTATGATGTG | 77 | 1282 |
| 1065731 | 465875 | 465894 | CTTGCCCATGGATGGTTGTC | 71 | 1283 |
| 1065747 | 466287 | 466306 | GTGGCTTATAGGTGGGTTCC | ND | 1284 |
| 1065763 | 466945 | 466964 | GGTTGTATGCCTTCTGCATT | 44 | 1285 |
| 1065779 | 468014 | 468033 | CCTTGCAGCACTTGTATAGT | 44 | 1286 |
| 1065795 | 470319 | 470338 | ACTATCCTGCATCCGAGGCA | 23 | 1287 |

TABLE 19-continued

Reduction of UBE3A-ATS RNA by 7,000 nM 5-10-5 MOE gapmers with mixed PO/PS internucleoside linkages in vitro (37,000 cells/well)

| Compound Number | SEQ ID NO: 1 Start Site | SEQ ID NO: 1 Stop Site | Sequence (5' to 3') | UBE3A-ATS (% UTC) | SEQ ID NO |
|---|---|---|---|---|---|
| 1065811 | 474227 | 474246 | ATATAATTGAGGGCCACCAT | 74 | 1288 |
| 1065827 | 475597 | 475616 | CCTTTAGAGGGATTTGTGTA | 34 | 1289 |
| 1065843 | 476097 | 476116 | CTTAACATGTTCATACGAGT | 47 | 1290 |
| 1065859 | 478733 | 478752 | GCTGATCACATTACCCATCC | 24 | 1291 |
| 1065875 | 480518 | 480537 | GATGTATCACGCAAACAATT | 81 | 1292 |
| 1065891 | 482167 | 482186 | ACCAAGGAGTTACAAGTGTC | 62 | 1293 |
| 1065907 | 483587 | 483606 | GGCCAGGATGGTCAACCTTA | 50 | 1294 |
| 1065922 | 484119 | 484138 | TTTTTGCCACAGCCGCTTGG | 193 | 1295 |
| 1065938 | 485811 | 485830 | CGAATAATTGCATGCCAACT | 68 | 1296 |
| 1065954 | 487606 | 487625 | GGTTTAGTGTCATATGTAGC | 23 | 1297 |
| 1065970 | 489324 | 489343 | GCACACACCTGTATAGGAGA | 43 | 1298 |
| 1065986 | 489780 | 489799 | CCTGCCACTCCCGTGGCAAC | 95 | 1299 |
| 1066002 | 493989 | 494008 | TTATGGGTAAGAGGTCGGTC | ND | 1300 |
| 1066018 | 496826 | 496845 | GGTATGGAGGCCATGTACGA | 84 | 1301 |
| 1066034 | 498510 | 498529 | GCGCCCGGCAAGAGATTCAC | ND | 1302 |
| 1066050 | 499912 | 499931 | TTGCATAATAGGAGGTCCTT | 51 | 1303 |
| 1066066 | 500662 | 500681 | GGGCTTACAACCTCTCAATT | 74 | 1304 |
| 1066082 | 500899 | 500918 | CCTAACTGGCCTTTGGGTCG | 80 | 1305 |
| 1066098 | 501446 | 501465 | GTCTGCACAGGTGGCATAGA | 53 | 1306 |
| 1066114 | 501817 | 501836 | GTCCAGAGGTCATATGGCCC | 54 | 1307 |
| 1066130 | 502416 | 502435 | GCATAAGTAAGGCATGGTCT | 41 | 1308 |
| 1066146 | 502755 | 502774 | CTTCGGGCAAATATGGCCCG | 76 | 1309 |
| 1066162 | 503036 | 503055 | GGTGCTACAGTCATACTATC | 62 | 1310 |
| 1066178 | 503346 | 503365 | GTGATCAGCTCAACACCCCC | 65 | 1311 |
| 1066194 | 503878 | 503897 | TAATAAAGGGTCAGTTGTGC | 39 | 1312 |
| 1066210 | 504270 | 504289 | CACTGCCTAAGCAAGGAATC | 86 | 1313 |
| 1066226 | 504530 | 504549 | TGCCCCAAAGATTTAGGCCA | 69 | 1314 |
| 1066242 | 505115 | 505134 | TCAGACATGGTAACCTTCAC | 40 | 1315 |
| 1066258 | 505660 | 505679 | ATTGCAGGCCTAGCTTCCAC | 51 | 1316 |
| 1066274 | 506031 | 506050 | GGTATTGAGTAGGACTTCTC | 34 | 1317 |
| 1066290 | 506402 | 506421 | CTTAAGGAGGCAACTCCTGA | 51 | 1318 |
| 1066306 | 506781 | 506800 | ATATACTCCAGGTTGTGGAG | 66 | 1319 |
| 1066322 | 507526 | 507545 | GAGCCAGGTTCCTGTTCACG | 33 | 1320 |
| 1066338 | 508110 | 508129 | CCGTCTTTAGGAACTTAAAT | 43 | 1321 |
| 1066354 | 508581 | 508600 | AGCACAACCCCCGTGCTGCT | 88 | 1322 |
| 1066370 | 509058 | 509077 | TACCCAACATGCTTGCATCC | 58 | 1323 |

TABLE 19-continued

Reduction of UBE3A-ATS RNA by 7,000 nM 5-10-5 MOE gapmers with mixed PO/PS internucleoside linkages in vitro (37,000 cells/well)

| Compound Number | SEQ ID NO: 1 Start Site | SEQ ID NO: 1 Stop Site | Sequence (5' to 3') | UBE3A-ATS (% UTC) | SEQ ID NO |
|---|---|---|---|---|---|
| 1066386 | 510022 | 510041 | ATACACGGAACCCACAGTAG | 70 | 1324 |
| 1066402 | 510402 | 510421 | CATGCTAGGGACTCTGATTG | 69 | 1325 |
| 1066418 | 510832 | 510851 | GTTAGACCAGGCATAAGTAC | 44 | 1326 |
| 1066434 | 511638 | 511657 | TGCAGCTGAGTGCCATATAA | 56 | 1327 |
| 1066450 | 511890 | 511909 | ACTACTTGGAGACCTTCACC | 57 | 1328 |

TABLE 20

Reduction of UBE3A-ATS RNA by 7,000 nm 5-10-5 MOE gapmers with mixed PO/PS internucleoside linkages in vitro (37,000 cells/well)

| Compound Number | SEQ ID NO: 1 Start Site | SEQ ID NO: 1 Stop Site | Sequence (5' to 3') | UBE3A-ATS (% UTC) | SEQ ID NO |
|---|---|---|---|---|---|
| 617557 | 483977 | 483996 | ATCATGTGCATACCCAGGGT | 35 | 172 |
| 749882 | 460115 | 460134 | ACTTTATAGTGTGGATGGTA | 26 | 586 |
| 749902 | 461442 | 461461 | GCTCCTGACAAATTAGCACT | 61 | 1329 |
| 750519 | 349103# | 349122# | GTCATCACCTCTCTTCAGGA | 20 | 181 |
| 1065258 | 430419 | 430438 | CGGATGCAGGGCACCCTTGG | 96 | 1330 |
| 1065274 | 432770 | 432789 | CATGATATAAGGAGAAACGC | 63 | 1331 |
| 1065290 | 440729 | 440748 | ATCTTGCGGCTGTCTCCCAG | 64 | 1332 |
| 1065306 | 442613 | 442632 | TCCCATAGTTATATGGCTCA | 60 | 1333 |
| 1065322 | 443476 | 443495 | CTGCATGTTAGATTGGGCAT | 48 | 1334 |
| 1065338 | 444879 | 444898 | GCTGTGATGCTAGGATGCAT | 84 | 1335 |
| 1065354 | 445874 | 445893 | AGACATAGACCCCAGACGGT | 83 | 1336 |
| 1065370 | 446795 | 446814 | CCCTTACCAGAATAGCATCC | 81 | 1337 |
| 1065386 | 447803 | 447822 | TGGTAGACCACTGATTCCCC | 63 | 1338 |
| 1065402 | 448415 | 448434 | AGCAAGGGTCTTAGTGCCAA | 60 | 1339 |
| 1065418 | 448742 | 448761 | GTCTGTATATTTAGACCACG | 83 | 1340 |
| 1065434 | 449159 | 449178 | GTCAACATTATATCGATGCA | 64 | 1341 |
| 1065450 | 449697 | 449716 | GTATGGCTTATGCATGCTAT | 86 | 1342 |
| 1065466 | 452137 | 452156 | TGGGCAGGTCAACTTGGTAT | 66 | 1343 |
| 1065482 | 453037 | 453056 | AAAAGGTGATTAGGCGGCCG | 88 | 1344 |
| 1065498 | 454156 | 454175 | TGACCCTTATGGAGACTTAT | 74 | 1345 |
| 1065514 | 454846 | 454865 | TCCAGGGTAGAAGACTAGCA | 63 | 1346 |
| 1065530 | 455286 | 455305 | GCAATAGAACAGATGGCCAT | 97 | 1347 |
| 1065546 | 455764 | 455783 | GTACCAAAGTGGCTGCTCAC | 89 | 1348 |
| 1065562 | 456866 | 456885 | ACTGCCCTCTTCGAAGAGAT | 71 | 1349 |
| 1065578 | 457715 | 457734 | GATTATCTCAGACATGCCAT | 20 | 1350 |

TABLE 20-continued

Reduction of UBE3A-ATS RNA by 7,000 nm 5-10-5 MOE gapmers with mixed PO/PS internucleoside linkages in vitro (37,000 cells/well)

| Compound Number | SEQ ID NO: 1 Start Site | SEQ ID NO: 1 Stop Site | Sequence (5' to 3') | UBE3A-ATS (% UTC) | SEQ ID NO |
|---|---|---|---|---|---|
| 1065594 | 458488 | 458507 | CCTTAAGCAAGGAGTTCACT | 39 | 1351 |
| 1065610 | 459543 | 459562 | ATCCTGGTATGACTGTCAGT | 45 | 1352 |
| 1065626 | 460538 | 460557 | GGCTCTCATCTAAATAAGCC | 75 | 1353 |
| 1065657 | 461674 | 461693 | AACCCTAAGGTGAAGTCTGT | 65 | 1354 |
| 1065672 | 463245 | 463264 | GGGTATTGCTGTCCAAATGG | 20 | 1355 |
| 1065687 | 464409 | 464428 | GTGTTATGGTTCCCATTCAG | 32 | 1356 |
| 1065702 | 465012 | 465031 | CCTGCTCAAATCTGCGAATA | 58 | 1357 |
| 1065718 | 465382 | 465401 | GACTTATTGAGGATGGTGTG | 53 | 1358 |
| 1065734 | 465894 | 465913 | TGAACTCCCACAAGGTACTC | 52 | 1359 |
| 1065750 | 466341 | 466360 | AGGCATTTGGAGCATTCGGG | 16 | 1360 |
| 1065766 | 467050 | 467069 | ACTTTCATCAGTTAGTCAGG | 30 | 1361 |
| 1065782 | 468343 | 468362 | CATTGACAAGCTATTGCAGC | 44 | 1362 |
| 1065798 | 470982 | 471001 | TTTTATGGCTTATAGCAGCG | 50 | 1363 |
| 1065814 | 474563 | 474582 | CACGCCCAAATGGAACTCTA | 38 | 1364 |
| 1065830 | 475827 | 475846 | GTGAGTTATAGAGTGTTCCC | 39 | 1365 |
| 1065846 | 476165 | 476184 | TGGGCACTTAGGAGTTCCTA | 73 | 1366 |
| 1065862 | 479069 | 479088 | GCTGTATCTGTGGTTTAGCA | 67 | 1367 |
| 1065878 | 480818 | 480837 | GCGGATGCCAGTGGCCGAGA | 40 | 1368 |
| 1065894 | 482519 | 482538 | GCTATACCCCTAGGATCAGA | 31 | 1369 |
| 1065910 | 483843 | 483862 | TAGGCATTGAATGAGGGCCC | 71 | 1370 |
| 1065925 | 484245 | 484264 | GTATGGACTTGTCTTATGGC | 57 | 1371 |
| 1065941 | 486351 | 486370 | AATAGACTGCGATTATACAA | 48 | 1372 |
| 1065957 | 487807 | 487826 | CGCAATTGAACTTAAATTGG | 56 | 1373 |
| 1065973 | 489517 | 489536 | GGACCACCTAAGACCTCAAG | 50 | 1374 |
| 1065989 | 489908 | 489927 | GGCTAAAGTAATCTTATGGG | 48 | 1375 |
| 1066005 | 494490 | 494509 | GTGCAATAGCCTAAATGCCA | 69 | 1376 |
| 1066021 | 497267 | 497286 | GGATTAGGCAGCTTCACTAC | 44 | 1377 |
| 1066037 | 499088 | 499107 | GCAAATACAATGGTAATCGC | 30 | 1378 |
| 1066053 | 500286 | 500305 | CTGGTGTACATTGGATATGA | 57 | 1379 |
| 1066069 | 500694 | 500713 | GCAAGAGGTACTGTAAGCCC | 70 | 1380 |
| 1066085 | 500993 | 501012 | ATCCGATAGTCAAACTATGA | 52 | 1381 |
| 1066101 | 501532 | 501551 | AAACACCCTTCCAATGAGGG | 75 | 1382 |
| 1066117 | 501986 | 502005 | GTTCACTAGCATCTGCTACA | 46 | 1383 |
| 1066133 | 502443 | 502462 | GCTCTTTGTAGGCCCAAGGG | 38 | 1384 |
| 1066149 | 502776 | 502795 | GGTTCCTATAAGGAATAGGC | 73 | 1385 |
| 1066165 | 503096 | 503115 | TAATAGGCCTTTCTACAGCT | 77 | 1386 |

TABLE 20-continued

Reduction of UBE3A-ATS RNA by 7,000 nm 5-10-5 MOE gapmers with mixed PO/PS internucleoside linkages in vitro (37,000 cells/well)

| Compound Number | SEQ ID NO: 1 Start Site | SEQ ID NO: 1 Stop Site | Sequence (5' to 3') | UBE3A-ATS (% UTC) | SEQ ID NO |
|---|---|---|---|---|---|
| 1066181 | 503374 | 503393 | CCCCAGGGTCATAGGAGTGT | 80 | 1387 |
| 1066197 | 503944 | 503963 | CCACCAACCTTAAATAGTAG | 70 | 1388 |
| 1066213 | 504390 | 504409 | CCACAGATTGGCTTGGAATG | 74 | 1389 |
| 1066229 | 504650 | 504669 | GCCTTACGCTTGGCTGACAT | 73 | 1390 |
| 1066245 | 505179 | 505198 | GTCTCTGTGTACCGAGCTCA | 63 | 1391 |
| 1066261 | 505724 | 505743 | GTCTGGTGGCCAAGTGCTTC | 70 | 1392 |
| 1066277 | 506116 | 506135 | AGCCGAGCATTGGCTTCATA | 73 | 1393 |
| 1066293 | 506584 | 506603 | GGTGGTGGAATGCTGTCCAC | 89 | 1394 |
| 1066309 | 506869 | 506888 | CTCCACCAAATACTTAGCCC | 67 | 1395 |
| 1066325 | 507649 | 507668 | TAAATGTCAGGAGGTCCCCC | 55 | 1396 |
| 1066341 | 508126 | 508145 | CCTTGGGTTATTCTTACCGT | 55 | 1397 |
| 1066357 | 508680 | 508699 | GGTAGTATAAGAATGGTTCC | 54 | 1398 |
| 1066373 | 509104 | 509123 | ATACACTTGGGCCCAAATGG | 78 | 1399 |
| 1066389 | 510039 | 510058 | GCTAGCATTTGAGAGTTATA | 43 | 1400 |
| 1066405 | 510647 | 510666 | GGCTGTAAGGGATTAAGATG | 79 | 1401 |
| 1066421 | 510853 | 510872 | CTGTTACAGGGAGACAATCT | 56 | 1402 |
| 1066437 | 511678 | 511697 | ACCCTGCACAAATGGACTGC | 103 | 1403 |

TABLE 21

Reduction of UBE3A-ATS RNA by 7,000 nM 5-10-5 MOE gapmers with mixed PO/PS internucleoside linkages in vitro (37,000 cells/well)

| Compound Number | SEQ ID NO: 1 Start Site | SEQ ID NO: 1 Stop Site | Sequence (5' to 3') | UBE3A-ATS (% UTC) | SEQ ID NO |
|---|---|---|---|---|---|
| 617557 | 483977 | 483996 | ATCATGTGCATACCCAGGGT | 42 | 172 |
| 749882 | 460115 | 460134 | ACTTTATAGTGTGGATGGTA | 33 | 586 |
| 750519 | 349103# | 349122# | GTCATCACCTCTCTTCAGGA | 21 | 181 |
| 1065268 | 432234 | 432253 | GGGCACCCCCGTCACCGTGC | 82 | 1404 |
| 1065284 | 433765 | 433784 | AGATTTTCCGACCTATGTCA | 62 | 1405 |
| 1065300 | 442386 | 442405 | ATCGCCATGGTCACTTGCCA | 63 | 1406 |
| 1065316 | 443032 | 443051 | GGCAAAGCAAGTTCGCCACA | 91 | 1407 |
| 1065332 | 444610 | 444629 | ATCATACAGGTCACTTGGCT | 63 | 1408 |
| 1065348 | 445505 | 445524 | ATTGGACTAGGTAACAGTGA | 103 | 1409 |
| 1065364 | 446595 | 446614 | CAGGCTATTTCTTAGTGGAC | 59 | 1410 |
| 1065380 | 447562 | 447581 | CAAGGGTAACCTATAGCTGA | 116 | 1411 |
| 1065396 | 448099 | 448118 | GCATATGCACACTTGGATCA | 89 | 1412 |

TABLE 21-continued

Reduction of UBE3A-ATS RNA by 7,000 nM 5-10-5 MOE gapmers with mixed PO/PS internucleoside linkages in vitro (37,000 cells/well)

| Compound Number | SEQ ID NO: 1 Start Site | SEQ ID NO: 1 Stop Site | Sequence (5' to 3') | UBE3A-ATS (% UTC) | SEQ ID NO |
|---|---|---|---|---|---|
| 1065412 | 448676 | 448695 | ACCCTGAAAACAATCAATCG | 102 | 1413 |
| 1065428 | 449061 | 449080 | ACGATAATCATGTGGCCTGA | 85 | 1414 |
| 1065444 | 449593 | 449612 | GACTAACTATACAGGTCTCT | 107 | 1415 |
| 1065460 | 451288 | 451307 | ACTACCTAGGCTCACTTGCT | 83 | 1416 |
| 1065476 | 452297 | 452316 | CCAGGATGCTAATGCTCCTA | 69 | 1417 |
| 1065492 | 453781 | 453800 | GCGCTTTCACCAAGAAATTT | 78 | 1418 |
| 1065508 | 454575 | 454594 | GCAAAGACTACACCGTGACA | 109 | 1419 |
| 1065524 | 455153 | 455172 | CCCCTGCATTCAGCTTATAG | 85 | 1420 |
| 1065540 | 455467 | 455486 | GCTATCCAAGTGACACAGTA | 77 | 1421 |
| 1065556 | 456757 | 456776 | GGGCCGCACATCTGGACCTC | 104 | 1422 |
| 1065572 | 457293 | 457312 | TACAAAACGACCTAAAGACC | 83 | 1423 |
| 1065588 | 458156 | 458175 | CTGCAATCCTTAAGACTTGA | 37 | 1424 |
| 1065604 | 458952 | 458971 | CCTCAAGACCTATAGGACCT | 37 | 1425 |
| 1065620 | 460284 | 460303 | ATACATTGCCAGCACTAAGG | 60 | 1426 |
| 1065636 | 460849 | 460868 | GATTTACCACACATATAGGC | 36 | 1427 |
| 1065651 | 461597 | 461616 | CGGGCTATGTGAGATAATTC | 15 | 1428 |
| 1065666 | 462686 | 462705 | GGCTGACATGCCCCTTTTAA | 142 | 1429 |
| 1065681 | 463881 | 463900 | GTTGTGATAGTCAACAATTG | 89 | 1430 |
| 1065697 | 464991 | 465010 | AGGCCCTCTTGTTTCAATTG | 63 | 1431 |
| 1065712 | 465246 | 465265 | GATTTTATTGGTCATCTCGG | 30 | 1432 |
| 1065728 | 465606 | 465625 | GCCTTTCTATTTCAGACCGA | 35 | 1433 |
| 1065744 | 466263 | 466282 | GGAGTCCATGAAGTAACTGG | 62 | 1434 |
| 1065760 | 466538 | 466557 | AGGTTGCATAAAGCCAGGCC | 55 | 1435 |
| 1065776 | 467801 | 467820 | CCCTCTTAGTGATTGGTGGT | 63 | 1436 |
| 1065792 | 470049 | 470068 | GGTTGGCAGTCTTCACCAGT | 62 | 1437 |
| 1065808 | 474120 | 474139 | GCTTGAATGGATACCAATTA | 40 | 1438 |
| 1065824 | 475447 | 475466 | CTCGGTCAAACTAATAATAC | 53 | 1439 |
| 1065840 | 476015 | 476034 | CCAGTTTTCGCCCGTTACCT | 32 | 1440 |
| 1065856 | 478440 | 478459 | GTAGCTATAGGTGTCACATA | 21 | 1441 |
| 1065872 | 480351 | 480370 | GCCTCAAATATGTGATGCAC | 45 | 1442 |
| 1065888 | 482108 | 482127 | GAATGGCAATACATCCGTGT | 80 | 1443 |
| 1065904 | 483359 | 483378 | TCAATGGACCCACATGATCA | 63 | 1444 |
| 1065920 | 483971 | 483990 | TGCATACCCAGGGTAGGATT | 29 | 1445 |
| 1065935 | 485084 | 485103 | TCTAATACTACAACGATGGA | 84 | 1446 |
| 1065951 | 487204 | 487223 | AACCTTCCTAAAATCCCCGA | 52 | 1447 |
| 1065967 | 489085 | 489104 | GATATACCCAGTTAATCAGT | 63 | 1448 |

TABLE 21-continued

Reduction of UBE3A-ATS RNA by 7,000 nM 5-10-5 MOE gapmers with mixed PO/PS internucleoside linkages in vitro (37,000 cells/well)

| Compound Number | SEQ ID NO: 1 Start Site | SEQ ID NO: 1 Stop Site | Sequence (5' to 3') | UBE3A-ATS (% UTC) | SEQ ID NO |
|---|---|---|---|---|---|
| 1065983 | 489731 | 489750 | ACCGGTTCCCAATTTTCTCC | 78 | 140 |
| 1065999 | 493889 | 493908 | TTGGCAGATGTAACCTATTC | 52 | 1449 |
| 1066015 | 496809 | 496828 | CGACCCTCATCACTTTTTGA | 73 | 1450 |
| 1066031 | 498209 | 498228 | ACGGGACCTCAATACTCTAC | 56 | 1451 |
| 1066047 | 499678 | 499697 | ATTCAAGGTAGCCCCAATAC | 89 | 1452 |
| 1066063 | 500578 | 500597 | CTACTGGCATCAGTCAAAAC | 84 | 150 |
| 1066079 | 500894 | 500913 | CTGGCCTTTGGGTCGGATAT | 86 | 1453 |
| 1066095 | 501390 | 501409 | CCCCAGATAATGCATAGATC | 98 | 1454 |
| 1066111 | 501763 | 501782 | GGGCTAAGAGTCACCTGTAT | 59 | 1455 |
| 1066127 | 502360 | 502379 | CCCTTGGCCACCTGACTTCG | 77 | 1456 |
| 1066143 | 502629 | 502648 | TTGGCTCAGTGTTCACTTCG | 52 | 1457 |
| 1066159 | 502939 | 502958 | GTAACCAGACCCAAGGCACT | 62 | 1458 |
| 1066175 | 503325 | 503344 | GAGATCCATGAGGTATATAC | 55 | 1459 |
| 1066191 | 503815 | 503834 | GCCCAGTGCCCTATAGGTCA | 67 | 1460 |
| 1066207 | 504127 | 504146 | GCTATTTCATTAAGTCACCC | 39 | 1461 |
| 1066223 | 504502 | 504521 | CCATGGAATGGCTGTCATGC | 72 | 1462 |
| 1066239 | 504974 | 504993 | TTATCTTCTTAGGGTCGACT | 38 | 1463 |
| 1066255 | 505635 | 505654 | AGCTATCCGCTTCCCAAGGG | 47 | 1464 |
| 1066271 | 505906 | 505925 | CCCTGAGATGCTAGTTGGGC | 85 | 1465 |
| 1066287 | 506256 | 506275 | GTATGTCCTTGGAGGTGAGC | 88 | 1466 |
| 1066303 | 506744 | 506763 | GCCTTTCATTTTGGGAGTGC | 48 | 1467 |
| 1066319 | 507364 | 507383 | GGCATGGAGATCCAACCTGT | 96 | 1468 |
| 1066335 | 507919 | 507938 | GGCACTGCAGGATAGCCATT | 95 | 1469 |
| 1066351 | 508470 | 508489 | CGTTATCCTAAGAAGTGACT | 58 | 1470 |
| 1066367 | 509003 | 509022 | TCAACATGTGTTAACGGAAC | 63 | 1471 |
| 1066383 | 509910 | 509929 | GTACCTGCAGTGCATAGAGC | 52 | 1472 |
| 1066399 | 510387 | 510406 | GATTGATTCAGTGCTCATGC | 49 | 1473 |
| 1066415 | 510747 | 510766 | ACTGCAGATAGGTAGGTGAT | 43 | 1474 |
| 1066431 | 511593 | 511612 | GTTGGAAGCTGCCAGCTTAG | 96 | 1475 |
| 1066447 | 511795 | 511814 | ACTGGCCTGTGGCAGTTAAC | 80 | 1476 |

TABLE 22

Reduction of UBE3A-ATS RNA by 7,000 nM 5-10-5 MOE gapmers with with mixed PO/PS internucleoside linkages in vitro (37,000 cells/well)

| Compound Number | SEQ ID NO: 1 Start Site | SEQ ID NO: 1 Stop Site | Sequence (5' to 3') | UBE3A-ATS (% UTC) | SEQ ID NO |
|---|---|---|---|---|---|
| 617557 | 483977 | 483996 | ATCATGTGCATACCCAGGGT | 28 | 172 |
| 749882 | 460115 | 460134 | ACTTTATAGTGTGGATGGTA | 24 | 586 |
| 750519 | 349103# | 349122# | GTCATCACCTCTCTTCAGGA | 17 | 181 |
| 1065261 | 430489 | 430508 | GCGCTGGCTCACGCATGCTC | 65 | 1477 |
| 1065277 | 432989 | 433008 | CCTAGAGTTTCCTTCTCCCG | 79 | 1478 |
| 1065293 | 441703 | 441722 | GGGATGCCAATGCCTCCAAC | 97 | 1479 |
| 1065309 | 442707 | 442726 | TAAATTGCCCTGGGTGCAGC | 71 | 1480 |
| 1065325 | 443778 | 443797 | GCCCTTTCAGGACCAACTGG | 107 | 1481 |
| 1065341 | 445116 | 445135 | GTTGGGCAAACAAGTTACCC | 92 | 1482 |
| 1065357 | 446183 | 446202 | GGGACCCCAATTTACTACGC | 112 | 1483 |
| 1065373 | 446912 | 446931 | CTTCTTGCAAGGATTGGCAC | 69 | 1484 |
| 1065389 | 447847 | 447866 | ACTGAGATGTGTGATACTCC | 70 | 1485 |
| 1065405 | 448471 | 448490 | CCACTCAATAGAATAGTGCC | 123 | 1486 |
| 1065421 | 448838 | 448857 | CCCAATTGCAAGGACCCTTA | 80 | 1487 |
| 1065437 | 449334 | 449353 | GAACATGTAGCCATAATGCC | 65 | 1488 |
| 1065453 | 449867 | 449886 | GAGTGGCATCCTTAAATCCT | 66 | 1489 |
| 1065469 | 452204 | 452223 | TAATTGGTCAAGTAAACAGC | 73 | 1490 |
| 1065485 | 453199 | 453218 | TCCACCGTTACTGATTATCT | 51 | 1491 |
| 1065501 | 454230 | 454249 | CAAGTCCCACCATGTTAATC | 87 | 1492 |
| 1065517 | 454913 | 454932 | GTTAGGATCTATTTGACAGC | 67 | 1493 |
| 1065533 | 455318 | 455337 | AGGCCTGCTCCGAATGTGTT | 107 | 1494 |
| 1065549 | 456627 | 456646 | GTGCATGGTTATCTAATGCA | 87 | 1495 |
| 1065565 | 456917 | 456936 | TTGGGTCACTAGGCACACTA | 110 | 1496 |
| 1065581 | 457899 | 457918 | TGACTAGTTCGATAAGTTTT | 48 | 1497 |
| 1065597 | 458561 | 458580 | TGTCGAGAACTCAAAAGGTG | 31 | 1498 |
| 1065613 | 459646 | 459665 | CTGTATAGTTTACCCAGGCA | 24 | 1499 |
| 1065629 | 460641 | 460660 | CAGAGTGCATTGGCAACTCG | 50 | 1500 |
| 1065644 | 461457 | 461476 | GATCTTGGTAAGGCAGCTCC | 29 | 1501 |
| 1065660 | 461891 | 461910 | CAATTTGGTCCCATTGTAGT | 84 | 1502 |
| 1065675 | 463503 | 463522 | TCTATCAAGGCTGTTATTGG | 40 | 1503 |
| 1065690 | 464528 | 464547 | GCTCAGTTAGGTTAGTGCAC | 23 | 1504 |
| 1065705 | 465162 | 465181 | TCTAGGGCTCCAGTTTATGT | 78 | 1505 |
| 1065721 | 465442 | 465461 | CTTTGGTTATGTACATTGCC | 73 | 1506 |
| 1065737 | 466098 | 466117 | GCCTGTATGTCTTGAGAAAC | 78 | 1507 |
| 1065753 | 466388 | 466407 | CTCGCTTTTCACAGGAGCGC | 36 | 1508 |
| 1065769 | 467300 | 467319 | TCACAGAGTAGTCTATTGGT | 43 | 1509 |

TABLE 22-continued

Reduction of UBE3A-ATS RNA by 7,000 nM 5-10-5 MOE gapmers with with mixed PO/PS internucleoside linkages in vitro (37,000 cells/well)

| Compound Number | SEQ ID NO: 1 Start Site | SEQ ID NO: 1 Stop Site | Sequence (5' to 3') | UBE3A-ATS (% UTC) | SEQ ID NO |
|---|---|---|---|---|---|
| 1065785 | 468922 | 468941 | GTAAGTATAGATGCCTCTCC | 33 | 1510 |
| 1065801 | 472475 | 472494 | GCAAACTTTAGGAGTGTGTT | 60 | 1511 |
| 1065817 | 474799 | 474818 | GGTATTGACACCTCCAACTG | 18 | 1512 |
| 1065833 | 475854 | 475873 | ATATAAGGGTAATACGGACC | 39 | 1513 |
| 1065849 | 476362 | 476381 | GCCCCCTGCCGTGTGAAAGA | 72 | 1514 |
| 1065865 | 479579 | 479598 | CTTCAAGACTAAGGTAGGGA | 38 | 1515 |
| 1065881 | 480923 | 480942 | GTATGCGAAGCGAACGAAGC | 75 | 1516 |
| 1065897 | 482786 | 482805 | CCTAAAAAACCCGTGTACAC | 62 | 1517 |
| 1065913 | 483907 | 483926 | GGTGGCCTTCAGTCAGTACA | 57 | 1518 |
| 1065928 | 484317 | 484336 | GCCCAGACTCATGCTGGTTA | 96 | 1519 |
| 1065944 | 486448 | 486467 | ATACTTCACCTAATAGCACC | 86 | 1520 |
| 1065960 | 488086 | 488105 | GGAGTTCTTTAGGTTGGAAC | 62 | 1521 |
| 1065976 | 489542 | 489561 | GCAACTATGGGTGGAGACAT | 53 | 1522 |
| 1065992 | 493191 | 493210 | TCGGGCCAGGTCCAGGCGCA | 52 | 1523 |
| 1066008 | 495127 | 495146 | GCTGTCATATGGGAACTACG | 57 | 1524 |
| 1066024 | 497743 | 497762 | CAAACCTACGCCAATAAAGA | 86 | 1525 |
| 1066040 | 499138 | 499157 | TTTATCGCTTAAAGTAGCCT | 83 | 1526 |
| 1066056 | 500407 | 500426 | CGTATATCGAATACCCTCAA | 33 | 1527 |
| 1066072 | 500818 | 500837 | GTAAGAGTTAGCTATTCCCC | 30 | 1528 |
| 1066088 | 501153 | 501172 | CAGTAAAGAGCCACCTAAGG | 71 | 1529 |
| 1066104 | 501574 | 501593 | GGCAAGGCTAAGGAGTGCTC | 54 | 1530 |
| 1066120 | 502129 | 502148 | GCTACCCATTAGACCCATGG | 34 | 1531 |
| 1066136 | 502502 | 502521 | GGAGTCCCTGTGTCATTGGA | 37 | 1532 |
| 1066152 | 502803 | 502822 | GGATGTAGCCCATCAACCCT | 77 | 1533 |
| 1066168 | 503118 | 503137 | CCAGTTAATCTCTGACATGG | 57 | 1534 |
| 1066184 | 503422 | 503441 | AGGTGATGACACCCCTACCA | 57 | 1535 |
| 1066200 | 503960 | 503979 | GGGTGTCTCTTTGACACCAC | 76 | 1536 |
| 1066216 | 504419 | 504438 | AGGCAGTCAGGGTAATGCTA | 76 | 1537 |
| 1066232 | 504667 | 504686 | CCTTCTGTCCCAACGGAGCC | 111 | 1538 |
| 1066248 | 505213 | 505232 | CTCTCGCTGAGGACACATCA | 64 | 1539 |
| 1066264 | 505791 | 505810 | ACCACAGGGTACTATTCTGG | 64 | 1540 |
| 1066280 | 506126 | 506145 | CTGCTCTGTTAGCCGAGCAT | 75 | 1541 |
| 1066296 | 506634 | 506653 | GCTTGTATGCCCCACTGGAG | 59 | 1542 |
| 1066312 | 507213 | 507232 | GCTTGCCATGTTTTATAGAC | 80 | 1543 |
| 1066328 | 507762 | 507781 | CTCAGGATCGCTGGCCATTT | 62 | 1544 |
| 1066344 | 508223 | 508242 | GCCTAAAGGTAGTTCTCCCT | 57 | 1545 |

TABLE 22-continued

Reduction of UBE3A-ATS RNA by 7,000 nM 5-10-5 MOE gapmers with mixed PO/PS internucleoside linkages in vitro (37,000 cells/well)

| Compound Number | SEQ ID NO: 1 Start Site | SEQ ID NO: 1 Stop Site | Sequence (5' to 3') | UBE3A-ATS (% UTC) | SEQ ID NO |
|---|---|---|---|---|---|
| 1066360 | 508731 | 508750 | CAGGAGGGTGTCAACCAGAC | 75 | 1546 |
| 1066376 | 509178 | 509197 | GGCAGATAACCTCCAAGTGC | 95 | 1547 |
| 1066392 | 510128 | 510147 | CACATAGACCATAGCTGAAC | 56 | 1548 |
| 1066408 | 510668 | 510687 | GTCTAGTATGTCTGAGTGTC | 87 | 1549 |
| 1066424 | 511065 | 511084 | GACTCGGGACATTTAGGATG | 72 | 1550 |
| 1066440 | 511730 | 511749 | ATAGGCCACGCTGGTCACTG | 48 | 1551 |

TABLE 23

Reduction of UBE3A-ATS RNA by 7,000 nM 5-10-5 MOE gapmers with mixed PO/PS internucleoside linkages in vitro (37,000 cells/well)

| Compound Number | SEQ ID NO: 1 Start Site | SEQ ID NO: 1 Stop Site | Sequence (5' to 3') | UBE3A-ATS (% UTC) | SEQ ID NO |
|---|---|---|---|---|---|
| 617557 | 483977 | 483996 | ATCATGTGCATACCCAGGGT | 39 | 172 |
| 749882 | 460115 | 460134 | ACTTTATAGTGTGGATGGTA | 16 | 586 |
| 750519 | 349103# | 349122# | GTCATCACCTCTCTTCAGGA | 14 | 181 |
| 1065260 | 430471 | 430490 | TCATCCTCTATGGACCCACG | 83 | 1552 |
| 1065276 | 432973 | 432992 | CCCGACTTACATTACCTACC | 69 | 1553 |
| 1065292 | 441621 | 441640 | ATGATCTGCTGTTCAGTGCG | 45 | 1554 |
| 1065308 | 442687 | 442706 | AGGCCAAGTGGTGCTCTTCC | 58 | 1555 |
| 1065324 | 443691 | 443710 | ATTCAGATACTAGTTTACCC | 36 | 1556 |
| 1065340 | 445011 | 445030 | TCTAGGTAGGCTGAGCCTCA | 89 | 1557 |
| 1065356 | 445972 | 445991 | TTGTCTTGGAACATACGGAT | 81 | 1558 |
| 1065372 | 446901 | 446920 | GATTGGCACTATTTTGAGCC | 113 | 1559 |
| 1065388 | 447835 | 447854 | GATACTCCAAATATGACCCG | 80 | 1560 |
| 1065404 | 448465 | 448484 | AATAGAATAGTGCCAGTAGG | 70 | 1561 |
| 1065420 | 448833 | 448852 | TTGCAAGGACCCTTAAGTCA | 87 | 1562 |
| 1065436 | 449328 | 449347 | GTAGCCATAATGCCATAGTC | 61 | 1563 |
| 1065452 | 449862 | 449881 | GCATCCTTAAATCCTGGTTG | 97 | 1564 |
| 1065468 | 452186 | 452205 | GCAATATCCATAGTGATCTG | 84 | 1565 |
| 1065484 | 453194 | 453213 | CGTTACTGATTATCTTATCC | 72 | 1566 |
| 1065500 | 454225 | 454244 | CCCACCATGTTAATCAAGGC | 69 | 1567 |
| 1065516 | 454863 | 454882 | CAGGTGTATATTCCCTATCC | 70 | 1568 |
| 1065532 | 455309 | 455328 | CCGAATGTGTTATTTATCCT | 58 | 1569 |
| 1065548 | 456621 | 456640 | GGTTATCTAATGCATCATCA | 71 | 1570 |
| 1065564 | 456909 | 456928 | CTAGGCACACTAAAGTGCAC | 84 | 1571 |
| 1065580 | 457802 | 457821 | GATGCAATCACAGCAAGTAC | 68 | 1572 |

TABLE 23-continued

Reduction of UBE3A-ATS RNA by 7,000 nM 5-10-5 MOE gapmers with mixed PO/PS internucleoside linkages in vitro (37,000 cells/well)

| Compound Number | SEQ ID NO: 1 Start Site | SEQ ID NO: 1 Stop Site | Sequence (5' to 3') | UBE3A-ATS (% UTC) | SEQ ID NO |
|---|---|---|---|---|---|
| 1065596 | 458560 | 458579 | GTCGAGAACTCAAAAGGTGA | 51 | 1573 |
| 1065612 | 459639 | 459658 | GTTTACCCAGGCAATGGCTC | 70 | 1574 |
| 1065628 | 460629 | 460648 | GCAACTCGATGTTCTTGCTT | 79 | 1575 |
| 1065643 | 461453 | 461472 | TTGGTAAGGCAGCTCCTGAC | 58 | 1576 |
| 1065659 | 461886 | 461905 | TGGTCCCATTGTAGTTGTGT | 50 | 1577 |
| 1065674 | 463502 | 463521 | CTATCAAGGCTGTTATTGGT | 29 | 1578 |
| 1065689 | 464477 | 464496 | GCTTCTAACTAACATGCCTC | 61 | 1579 |
| 1065704 | 465158 | 465177 | GGGCTCCAGTTTATGTATCC | 79 | 1580 |
| 1065720 | 465418 | 465437 | TAGCCTGCATGGTTTACAGT | 72 | 1581 |
| 1065736 | 466030 | 466049 | GGGCTCTTGTTACTGAGCTG | 79 | 1582 |
| 1065752 | 466382 | 466401 | TTTCACAGGAGCGCACTTGG | 55 | 1583 |
| 1065768 | 467295 | 467314 | GAGTAGTCTATTGGTGTTCC | 27 | 1584 |
| 1065784 | 468404 | 468423 | CCCTACCCTTGCATGCTATG | 75 | 1585 |
| 1065800 | 471928 | 471947 | CCATTGAGTATATTACCTCC | 45 | 1586 |
| 1065816 | 474789 | 474808 | CCTCCAACTGTAATCATTGA | 65 | 1587 |
| 1065832 | 475846 | 475865 | GTAATACGGACCTCATACAG | 61 | 1588 |
| 1065848 | 476316 | 476335 | ACTACTTGTCCCCTGGGCTT | 45 | 1589 |
| 1065864 | 479256 | 479275 | CTTGCTTGTATGGTCTGATG | 63 | 1590 |
| 1065880 | 480830 | 480849 | AAAAGTAGGTTTGCGGATGC | 61 | 1591 |
| 1065896 | 482778 | 482797 | ACCCGTGTACACAGTGGGAT | 60 | 1592 |
| 1065912 | 483896 | 483915 | GTCAGTACACAAGCAGGTAG | 68 | 1593 |
| 1065927 | 484309 | 484328 | TCATGCTGGTTACTAGGGCC | 42 | 1594 |
| 1065943 | 486378 | 486397 | GTTAGGCCACAAGACTTAAT | 51 | 1595 |
| 1065959 | 488046 | 488065 | CTCAAACCCGTATAAAGATG | 58 | 1596 |
| 1065975 | 489527 | 489546 | GACATACAATGGACCACCTA | 70 | 1597 |
| 1065991 | 489961 | 489980 | GGAAGTTCCAACCCTTACTC | 64 | 1598 |
| 1066007 | 494921 | 494940 | GAATCCACTACATGGGATTA | 110 | 1599 |
| 1066023 | 497674 | 497693 | GACTAAGCCCGAAAGTTAGC | 79 | 1600 |
| 1066039 | 499133 | 499152 | CGCTTAAAGTAGCCTAAGGA | 41 | 1601 |
| 1066055 | 500400 | 500419 | CGAATACCCTCAACTTCACC | 59 | 1602 |
| 1066071 | 500797 | 500816 | CAACCTTGATAGCAGCTTAT | 38 | 1603 |
| 1066087 | 501007 | 501026 | GTGAAACTAAGCACATCCGA | 77 | 1604 |
| 1066103 | 501569 | 501588 | GGCTAAGGAGTGCTCTTTGT | 66 | 1605 |
| 1066119 | 502125 | 502144 | CCCATTAGACCCATGGCTCA | 21 | 1606 |
| 1066135 | 502465 | 502484 | TACAACAGTCCCAGGCTAGG | 51 | 1607 |
| 1066151 | 502799 | 502818 | GTAGCCCATCAACCCTGGGA | 72 | 1608 |

TABLE 23-continued

Reduction of UBE3A-ATS RNA by 7,000 nM 5-10-5 MOE gapmers with mixed PO/PS internucleoside linkages in vitro (37,000 cells/well)

| Compound Number | SEQ ID NO: 1 Start Site | SEQ ID NO: 1 Stop Site | Sequence (5' to 3') | UBE3A-ATS (% UTC) | SEQ ID NO |
|---|---|---|---|---|---|
| 1066167 | 503107 | 503126 | CTGACATGGACTAATAGGCC | 47 | 1609 |
| 1066183 | 503415 | 503434 | GACACCCCTACCATGGCTAC | 54 | 1610 |
| 1066199 | 503956 | 503975 | GTCTCTTTGACACCACCAAC | 62 | 1611 |
| 1066215 | 504408 | 504427 | GTAATGCTATCTTCCATGCC | 47 | 1612 |
| 1066231 | 504661 | 504680 | GTCCCAACGGAGCCTTACGC | 62 | 1613 |
| 1066247 | 505200 | 505219 | CACATCAGCTGTTAGCAGTC | 64 | 1614 |
| 1066263 | 505749 | 505768 | ACTCTGTAGGTTGACAGGAC | 59 | 1615 |
| 1066279 | 506121 | 506140 | CTGTTAGCCGAGCATTGGCT | 88 | 1616 |
| 1066295 | 506628 | 506647 | ATGCCCCACTGGAGAAGTCT | 77 | 1617 |
| 1066311 | 506997 | 507016 | CGTCTTCCCGCACCATGCAT | 40 | 1618 |
| 1066327 | 507699 | 507718 | CGTGTCACTTTCAGGTCAGC | 59 | 1619 |
| 1066343 | 508216 | 508235 | GGTAGTTCTCCCTTCTGTCA | 73 | 1620 |
| 1066359 | 508726 | 508745 | GGGTGTCAACCAGACTTCCA | ND | 1621 |
| 1066375 | 509128 | 509147 | GCTCATCACAACTGGGTGGT | 35 | 1622 |
| 1066391 | 510121 | 510140 | ACCATAGCTGAACCTGTGGC | 62 | 1623 |
| 1066407 | 510659 | 510678 | GTCTGAGTGTCAGGCTGTAA | 68 | 1624 |
| 1066423 | 510905 | 510924 | GTGTGCCATAGGTTTCAGGC | 18 | 1625 |
| 1066439 | 511725 | 511744 | CCACGCTGGTCACTGAAAGA | 70 | 1626 |

TABLE 24

Reduction of UBE3A-ATS RNA by 7,000 nM 5-10-5 MOE gapmers with mixed PO/PS internucleoside linkages in vitro (37,000 cells/well)

| Compound Number | SEQ ID NO: 1 Start Site | SEQ ID NO: 1 Stop Site | Sequence (5' to 3') | UBE3A-ATS (% UTC) | SEQ ID NO |
|---|---|---|---|---|---|
| 617557 | 483977 | 483996 | ATCATGTGCATACCCAGGGT | 49 | 172 |
| 749882 | 460115 | 460134 | ACTTTATAGTGTGGATGGTA | 25 | 586 |
| 750519 | 349103# | 349122# | GTCATCACCTCTCTTCAGGA | 10 | 181 |
| 1065266 | 432182 | 432201 | CCGCTCAATGCAGGACACCA | 79 | 1627 |
| 1065282 | 433495 | 433514 | TGCTCCATAGGTAAGATGGT | 82 | 1628 |
| 1065298 | 442149 | 442168 | TAGGCACTGCCTTTGTTGCG | 87 | 1629 |
| 1065314 | 442877 | 442896 | GTCGAAGACAATATAACATC | 59 | 1630 |
| 1065330 | 444418 | 444437 | ATCAGGGCACATGGAGTTGT | 21 | 1631 |
| 1065346 | 445359 | 445378 | CCCTTAGGTGGGAGTCTTCC | 128 | 1632 |
| 1065362 | 446536 | 446555 | GGCTCTAGACCATTGACTCA | 72 | 1633 |
| 1065378 | 447498 | 447517 | GTAGTGCCTCAATGATCCAC | 62 | 1634 |
| 1065394 | 448042 | 448061 | GGTAAAGTGGACTGGATGCC | 66 | 1635 |

TABLE 24-continued

Reduction of UBE3A-ATS RNA by 7,000 nM 5-10-5 MOE gapmers with mixed PO/PS internucleoside linkages in vitro (37,000 cells/well)

| Compound Number | SEQ ID NO: 1 Start Site | SEQ ID NO: 1 Stop Site | Sequence (5' to 3') | UBE3A-ATS (% UTC) | SEQ ID NO |
|---|---|---|---|---|---|
| 1065410 | 448635 | 448654 | CTCATGAGGATTGCATCACA | 71 | 1636 |
| 1065426 | 449041 | 449060 | AGGAACGGCCCTGACTGTCA | 110 | 1637 |
| 1065442 | 449492 | 449511 | CCATATCAATAACAATTGGC | 111 | 1638 |
| 1065458 | 450273 | 450292 | GGAACTCCAGCCAGTGAATA | 96 | 1639 |
| 1065474 | 452270 | 452289 | ATGAGGGAAGTCTAGGTCTC | 80 | 1640 |
| 1065490 | 453360 | 453379 | ACATAGGCACTCTACTAGCT | 101 | 1641 |
| 1065506 | 454514 | 454533 | TATCAGTCATAGCTACACAC | 104 | 1642 |
| 1065522 | 455119 | 455138 | GGTGGATGTCTGACTTGACT | 61 | 1643 |
| 1065538 | 455426 | 455445 | GCTAAAGTTGTGGTCTACCA | 83 | 1644 |
| 1065554 | 220324 456693 | 220343 456712 | TTCTCATCATCGATCCAAAC | 60 | 1645 |
| 1065570 | 457238 | 457257 | TAATGGCTTAGCTACTCACC | 90 | 1646 |
| 1065586 | 457994 | 458013 | GAGAACCCACTTGATCTATT | 24 | 1647 |
| 1065602 | 458938 | 458957 | GGACCTCAGGAGATTGTACA | 35 | 1648 |
| 1065618 | 460111 | 460130 | TATAGTGTGGATGGTATCCT | 31 | 1649 |
| 1065634 | 460744 | 460763 | GTACACAGGGATTTGAGCCT | 12* | 1650 |
| 1065649 | 461528 | 461547 | GGAACATTCAGCTAGACTAG | 40 | 1651 |
| 1065665 | 462567 | 462586 | TAAATTGGTCTGGTTACAAG | 56 | 1652 |
| 1065679 | 463779 | 463798 | CCTATAGATTGGGCTTTAGA | 48 | 1653 |
| 1065695 | 464905 | 464924 | GTCTATATTTGGTAAGACAC | 69 | 1654 |
| 1065710 | 465240 | 465259 | ATTGGTCATCTCGGGTATAT | 18 | 1655 |
| 1065726 | 465596 | 465615 | TTCAGACCGAAGGAGTTCCT | 60 | 1656 |
| 1065742 | 466244 | 466263 | GTAGGATCTATGGCAGTTCC | 59 | 1657 |
| 1065758 | 466448 | 466467 | GTTCTACAGAGTGGAGCCAG | 65 | 1658 |
| 1065774 | 467791 | 467810 | GATTGGTGGTTTATTCATCG | 47 | 1659 |
| 1065790 | 469893 | 469912 | TACCCATTGCAAGTTAACTA | 73 | 1660 |
| 1065806 | 473260 | 473279 | TCCTAATAGTTGGAGGTGGT | ND | 1661 |
| 1065822 | 474959 | 474978 | CAGCCTAATATGTGTCATCC | 40 | 1662 |
| 1065838 | 476003 | 476022 | CGTTACCTCAATTCTATGGT | 49 | 1663 |
| 1065854 | 478299 | 478318 | ACTGGAGTCCTGGTTGATGT | 67 | 1664 |
| 1065870 | 480146 | 480165 | ACAAAACGGGCATGCTTTAT | 63 | 1665 |
| 1065886 | 481476 | 481495 | GCGGATAAATTGGATTTATC | 37 | 1666 |
| 1065902 | 483108 | 483127 | AGGCAATGGACTTAGTACAC | 21 | 1667 |
| 1065918 | 483965 | 483984 | CCCAGGGTAGGATTCATGGT | 45 | 1668 |
| 1065933 | 484683 | 484702 | CAAGTGATGATGTTGTATGC | 87 | 1669 |
| 1065949 | 487192 | 487211 | ATCCCCGAATGGGAGAGATT | 107 | 1670 |
| 1065965 | 489067 | 489086 | GTGAACGAATACTGTGGCAT | 59 | 1671 |

TABLE 24-continued

Reduction of UBE3A-ATS RNA by 7,000 nM 5-10-5 MOE gapmers with mixed PO/PS internucleoside linkages in vitro (37,000 cells/well)

| Compound Number | SEQ ID NO: 1 Start Site | SEQ ID NO: 1 Stop Site | Sequence (5' to 3') | UBE3A-ATS (% UTC) | SEQ ID NO |
|---|---|---|---|---|---|
| 1065981 | 489671 | 489690 | CCAACCTGTCATGGGACTGC | 45 | 1672 |
| 1065997 | 493859 | 493878 | TAGGCCTAATCTATGCTGGG | 44 | 1673 |
| 1066013 | 496023 | 496042 | TCTCAAAAGACATTCGGTAC | 137 | 1674 |
| 1066029 | 498183 | 498202 | CCATGGGCAGATTGATCACC | 102 | 1675 |
| 1066045 | 499515 | 499534 | TGCCTAAGGGAGTTTGTCAC | 73 | 1676 |
| 1066061 | 500527 | 500546 | ATGTTTAGAGGTCAAGCCCT | 91 | 1677 |
| 1066077 | 500886 | 500905 | TGGGTCGGATATAGCTTTTA | 58 | 1678 |
| 1066093 | 501347 | 501366 | GACATCTGCTTATGTAGCTC | 45 | 1679 |
| 1066109 | 501708 | 501727 | AGTTACTTTGGGACATCCCA | 68 | 1680 |
| 1066125 | 502209 | 502228 | GTTTGGAACATCATGTTAGC | 49 | 1681 |
| 1066141 | 502595 | 502614 | TCCAACTGATGCATCAAGCC | 43 | 1682 |
| 1066157 | 502904 | 502923 | GCCTATATCCAACCAGCTAC | 73 | 1683 |
| 1066173 | 503217 | 503236 | CGTTGGAAACTTCAAAGGCA | 69 | 1684 |
| 1066189 | 503506 | 503525 | CCTTGGTTGTGGTGAAACCC | 72 | 1685 |
| 1066205 | 504087 | 504106 | TATCTTAACTGGTGAACTCC | 73 | 1686 |
| 1066221 | 504477 | 504496 | GGATGGTTGACCTCAAAATT | 30 | 1687 |
| 1066237 | 504952 | 504971 | TGGTTACCCATACAGTATAT | 42 | 1688 |
| 1066253 | 505549 | 505568 | GCTTTTCAGTCAGGTACAGG | 29 | 1689 |
| 1066269 | 505828 | 505847 | GACCTGTGAGGGTGCTTAGT | 81 | 1690 |
| 1066285 | 506235 | 506254 | GTTTGACCAGCTCCTTGTTG | 76 | 1691 |
| 1066301 | 506734 | 506753 | TTGGGAGTGCTCCACACTTC | 72 | 1692 |
| 1066317 | 507331 | 507350 | GATGCCCTGGTCCTAGCTTC | 60 | 1693 |
| 1066333 | 507909 | 507928 | GATAGCCATTCGATACCTGC | 56 | 1694 |
| 1066349 | 508297 | 508316 | GCTTCTACATAACCGAAGTG | 116 | 1695 |
| 1066365 | 508933 | 508952 | CTAGTGCCTATTACAATCTG | 61 | 1696 |
| 1066381 | 509882 | 509901 | CATGTGCTTTGTGGACCCAT | 47 | 1697 |
| 1066397 | 510318 | 510337 | GCTGGACGGACAGTGTTGCT | 61 | 1698 |
| 1066413 | 510733 | 510752 | GGTGATGAAGGTCAAGCCGA | 103 | 1699 |
| 1066429 | 511561 | 511580 | GTGGTTTCCAGCAGGGTGTA | 20 | 1700 |
| 1066445 | 511777 | 511796 | ACTAAAGAGTACTCCTACCA | 110 | 1701 |

TABLE 25

Reduction of UBE3A-ATS RNA by 7,000 5-10-5 MOE gapmers with mixed PO/PS internucleoside linkages in vitro (37,000 cells/well)

| Compound Number | SEQ ID NO: 1 Start Site | SEQ ID NO: 1 Stop Site | Sequence (5' to 3') | UBE3A-ATS (% UTC) | SEQ ID NO |
|---|---|---|---|---|---|
| 617557 | 483977 | 483996 | ATCATGTGCATACCCAGGGT | 34 | 172 |
| 749882 | 460115 | 460134 | ACTTTATAGTGTGGATGGTA | 30 | 586 |
| 749921 | 462626 | 462645 | GTAATGATTTGCCCTCCTAC | 32 | 1702 |
| 750519 | 349103# | 349122# | GTCATCACCTCTCTTCAGGA | 17 | 181 |
| 1065267 | 432208 | 432227 | CCAGCGGGACCTGGACAAGC | 62 | 1703 |
| 1065283 | 433699 | 433718 | GGTGTAGTGGCAAGAAGTTC | 59 | 1704 |
| 1065299 | 442231 | 442250 | CCCCCTAGCTTTCCAATGGG | 82 | 1705 |
| 1065315 | 442923 | 442942 | GTCTCCACATAATCCTATTG | 48 | 1706 |
| 1065331 | 444553 | 444572 | ACATCCCATTAATCATCGCT | 49 | 1707 |
| 1065347 | 445388 | 445407 | TCAGATTACCTGAAGGTGTA | 104 | 1708 |
| 1065363 | 446582 | 446601 | AGTGGACAGATACGGTCCGT | 95 | 1709 |
| 1065379 | 447508 | 447527 | TCAGTTGTGAGTAGTGCCTC | 75 | 1710 |
| 1065395 | 448074 | 448093 | GCTTACCAGAGATGGTTTCC | 111 | 1711 |
| 1065411 | 448658 | 448677 | CGTAGGGCAAAAGTAAGGAT | 71 | 1712 |
| 1065427 | 449050 | 449069 | GTGGCCTGAAGGAACGGCCC | 92 | 1713 |
| 1065443 | 449532 | 449551 | GACCTTCAATTGATCAGTCT | 112 | 1714 |
| 1065459 | 450791 | 450810 | CCTGTCTGGTACTCCCATAT | 69 | 1715 |
| 1065475 | 452275 | 452294 | TCAATATGAGGGAAGTCTAG | 73 | 1716 |
| 1065491 | 453366 | 453385 | TTAACTACATAGGCACTCTA | 76 | 1717 |
| 1065507 | 454568 | 454587 | CTACACCGTGACAAAAGAGC | 76 | 1718 |
| 1065523 | 455125 | 455144 | AGCACAGGTGGATGTCTGAC | 82 | 1719 |
| 1065539 | 455450 | 455469 | GTAGTTGTATCTTGAATGGG | 65 | 1720 |
| 1065555 | 220380 456749 | 220399 456768 | CATCTGGACCTCAGATTGAC | 64 | 1721 |
| 1065571 | 457288 | 457307 | AACGACCTAAAGACCTAGCA | 36 | 1722 |
| 1065587 | 458044 | 458063 | CTTGAGTAACTACTCATGAC | 83 | 1723 |
| 1065603 | 458946 | 458965 | GACCTATAGGACCTCAGGAG | 33 | 1724 |
| 1065619 | 460118 | 460137 | CTAACTTTATAGTGTGGATG | 18 | 1725 |
| 1065635 | 460843 | 460862 | CCACACATATAGGCTAGCCA | 9 | 1726 |
| 1065650 | 461573 | 461592 | GGTCATCATATTGAACCAAT | 44 | 1727 |
| 1065680 | 463826 | 463845 | GATTTCCTTACTGAGTGAGC | 29 | 1728 |
| 1065696 | 464909 | 464928 | GGTAGTCTATATTTGGTAAG | 17 | 1729 |
| 1065711 | 465242 | 465261 | TTATTGGTCATCTCGGGTAT | 47 | 1730 |
| 1065727 | 465600 | 465619 | CTATTTCAGACCGAAGGAGT | 32 | 1731 |
| 1065743 | 466251 | 466270 | GTAACTGGTAGGATCTATGG | 49 | 1732 |
| 1065759 | 466496 | 466515 | TTTTTAGGGTAGTGTCCTGA | 92 | 1733 |
| 1065775 | 467797 | 467816 | CTTAGTGATTGGTGGTTTAT | 54 | 1734 |

TABLE 25-continued

Reduction of UBE3A-ATS RNA by 7,000 5-10-5 MOE gapmers with mixed PO/PS internucleoside linkages in vitro (37,000 cells/well)

| Compound Number | SEQ ID NO: 1 Start Site | SEQ ID NO: 1 Stop Site | Sequence (5' to 3') | UBE3A-ATS (% UTC) | SEQ ID NO |
|---|---|---|---|---|---|
| 1065791 | 469899 | 469918 | GGGATTTACCCATTGCAAGT | ND | 1735 |
| 1065807 | 473264 | 473283 | GCCATCCTAATAGTTGGAGG | 44 | 1736 |
| 1065823 | 475306 | 475325 | GGTTAAGTCTGCTCTTTCAC | 25 | 1737 |
| 1065839 | 476008 | 476027 | TCGCCCGTTACCTCAATTCT | 60 | 1738 |
| 1065855 | 478307 | 478326 | GCTATTACACTGGAGTCCTG | 45 | 1739 |
| 1065871 | 480150 | 480169 | CAATACAAAACGGGCATGCT | 94 | 1740 |
| 1065887 | 481747 | 481766 | GATCATTCCCTGTGGTAAAG | 68 | 1741 |
| 1065903 | 483112 | 483131 | GCTTAGGCAATGGACTTAGT | 11 | 1742 |
| 1065919 | 483969 | 483988 | CATACCCAGGGTAGGATTCA | 43 | 1743 |
| 1065934 | 484722 | 484741 | ATAACACTAACGATGAACTC | 37 | 1744 |
| 1065950 | 487198 | 487217 | CCTAAAATCCCCGAATGGGA | 98 | 1745 |
| 1065966 | 489079 | 489098 | CCCAGTTAATCAGTGAACGA | 77 | 1746 |
| 1065982 | 489676 | 489695 | ATGTTCCAACCTGTCATGGG | 71 | 1747 |
| 1065998 | 493867 | 493886 | GATGAGATTAGGCCTAATCT | 43 | 1748 |
| 1066014 | 496564 | 496583 | CCATCTACTATTAATGAGCT | 58 | 1749 |
| 1066030 | 498186 | 498205 | TCACCATGGGCAGATTGATC | 109 | 1750 |
| 1066046 | 499672 | 499691 | GGTAGCCCCAATACAGATTC | 26 | 72 |
| 1066062 | 500564 | 500583 | CAAAACATGTTCTGACCTCG | 93 | 1751 |
| 1066078 | 500892 | 500911 | GGCCTTTGGGTCGGATATAG | 93 | 1752 |
| 1066094 | 501356 | 501375 | CGTCAAACTGACATCTGCTT | 38 | 1753 |
| 1066110 | 501733 | 501752 | AGTTAACACCTATCAAGTTG | 58 | 1754 |
| 1066126 | 502355 | 502374 | GGCCACCTGACTTCGGCCCA | 115 | 1755 |
| 1066142 | 502599 | 502618 | GACTTCCAACTGATGCATCA | 42 | 1756 |
| 1066158 | 502919 | 502938 | GACCCTTCTGTGAAAGCCTA | 61 | 1757 |
| 1066174 | 503279 | 503298 | GACTGCATCTCAATCCTATG | 62 | 1758 |
| 1066190 | 503636 | 503655 | GCCCATATGCTTGAACAATT | 40 | 1759 |
| 1066206 | 504088 | 504107 | GTATCTTAACTGGTGAACTC | 55 | 1760 |
| 1066222 | 504484 | 504503 | GCAGTTTGGATGGTTGACCT | 43 | 1761 |
| 1066238 | 504963 | 504982 | GGGTCGACTGATGGTTACCC | 80 | 1762 |
| 1066254 | 505594 | 505613 | ATAGGAGCTGAATAGTAGGG | 37 | 1763 |
| 1066270 | 505833 | 505852 | TCAAAGACCTGTGAGGGTGC | 78 | 1764 |
| 1066286 | 506243 | 506262 | GGTGAGCTGTTTGACCAGCT | 49 | 1765 |
| 1066302 | 506739 | 506758 | TCATTTTGGGAGTGCTCCAC | 53 | 1766 |
| 1066318 | 507359 | 507378 | GGAGATCCAACCTGTGTGGA | 79 | 1767 |
| 1066334 | 507915 | 507934 | CTGCAGGATAGCCATTCGAT | 69 | 1768 |
| 1066350 | 508354 | 508373 | CATTATTCAATTAAGGGTGG | 15 | 1769 |
| 1066366 | 508999 | 509018 | CATGTGTTAACGGAACTGAG | 85 | 1770 |

TABLE 25-continued

Reduction of UBE3A-ATS RNA by 7,000 5-10-5 MOE gapmers with mixed PO/PS internucleoside linkages in vitro (37,000 cells/well)

| Compound Number | SEQ ID NO: 1 Start Site | SEQ ID NO: 1 Stop Site | Sequence (5' to 3') | UBE3A-ATS (% UTC) | SEQ ID NO |
|---|---|---|---|---|---|
| 1066382 | 509901 | 509920 | GTGCATAGAGCAGACTGTAC | 103 | 1771 |
| 1066398 | 510328 | 510347 | GGTTTTGAGAGCTGGACGGA | 57 | 1772 |
| 1066414 | 510740 | 510759 | ATAGGTAGGTGATGAAGGTC | 75 | 1773 |
| 1066430 | 511586 | 511605 | GCTGCCAGCTTAGAGAATCT | 95 | 1774 |
| 1066446 | 511781 | 511800 | GTTAACTAAAGAGTACTCCT | 92 | 1775 |

TABLE 26

Reduction of UBE3A-ATS RNA by 7,000 nM 5-10-5 MOE gapmers with mixed PO/PS internucleoside linkages in vitro (37,000 cells/well)

| Compound Number | SEQ ID NO: 1 Start Site | SEQ ID NO: 1 Stop Site | Sequence (5' to 3') | UBE3A-ATS (% UTC) | SEQ ID NO |
|---|---|---|---|---|---|
| 617557 | 483977 | 483996 | ATCATGTGCATACCCAGGGT | 35 | 172 |
| 749882 | 460115 | 460134 | ACTTTATAGTGTGGATGGTA | 42 | 586 |
| 749960 | 465003 | 465022 | ATCTGCGAATAGAGGCCCTC | 56 | 33 |
| 750519 | 349103# | 349122# | GTCATCACCTCTCTTCAGGA | 16 | 181 |
| 1065272 | 432587 | 432606 | GTAGGAGATAGGCAGTGCAT | 25 | 1776 |
| 1065288 | 440174 | 440193 | AATTATACTGTCCTACTTCG | 65 | 1777 |
| 1065304 | 442560 | 442579 | GTACCCCAGAAATAGCCCAT | 45 | 1778 |
| 1065320 | 443271 | 443290 | CATCACTAGCCTAGTGATCT | 114 | 1779 |
| 1065336 | 444826 | 444845 | GGGTGCTGTCAACTGTCCCA | 45 | 1780 |
| 1065352 | 445690 | 445709 | GGCAAAGTACATACTGATCC | 54 | 1781 |
| 1065368 | 446725 | 446744 | CCTGTGCGGTAGCACTTGCC | 80 | 1782 |
| 1065384 | 447772 | 447791 | GGGCCAAGCACATAGGTATC | 74 | 1783 |
| 1065400 | 448306 | 448325 | CGTGCAAAACAAGTTTCGCA | 91 | 1784 |
| 1065416 | 448729 | 448748 | GACCACGATAACTGTAGCGC | 62 | 1785 |
| 1065432 | 449105 | 449124 | TCCTGGCAAGTATGCTAGTC | 73 | 1786 |
| 1065448 | 449643 | 449662 | ACTGATCCATTAGATAGGCT | 53 | 1787 |
| 1065464 | 452074 | 452093 | AGAACACTTCGCCGCTGATT | 76 | 1788 |
| 1065480 | 452327 | 452346 | AACATAAGGTTCAAAAGCCG | 86 | 1789 |
| 1065496 | 454063 | 454082 | CATAGATGATCCCATAATAG | 77 | 1790 |
| 1065512 | 454746 | 454765 | CCGAAAGCACTTTGCATGAG | 70 | 1791 |
| 1065528 | 455227 | 455246 | ATCCTTGATCCAGACAAGTC | 76 | 1792 |
| 1065544 | 455606 | 455625 | ATCATACAGGCATCTCAGCC | 68 | 1793 |
| 1065560 | 220447 456816 | 220466 456835 | TGTCACTGAGGGATCCCCAA | 83 | 1794 |
| 1065576 | 457383 | 457402 | GGATTCAATAGTGTAGGTGA | 15 | 1795 |

TABLE 26-continued

Reduction of UBE3A-ATS RNA by 7,000 nM 5-10-5 MOE gapmers with mixed PO/PS internucleoside linkages in vitro (37,000 cells/well)

| Compound Number | SEQ ID NO: 1 Start Site | SEQ ID NO: 1 Stop Site | Sequence (5' to 3') | UBE3A-ATS (% UTC) | SEQ ID NO |
|---|---|---|---|---|---|
| 1065592 | 458407 | 458426 | GTACAATGCATGTGGGCCTC | ND | 1796 |
| 1065608 | 459102 | 459121 | ACTGGCATATTCCGATTATA | 24 | 1797 |
| 1065624 | 460467 | 460486 | CGTATTGGACCTTTCAATGA | 28 | 1798 |
| 1065640 | 461349 | 461368 | ATTGAAGCTGGCAATATGTC | 67 | 1799 |
| 1065655 | 461608 | 461627 | GCATGTACAAACGGGCTATG | 33 | 1800 |
| 1065670 | 463188 | 463207 | GGAATCTTGTAGAGGATTGG | 51 | 1801 |
| 1065685 | 464393 | 464412 | TCAGCACTTAGGTAGTTCAC | 27 | 1802 |
| 1065716 | 465309 | 465328 | TGTCTTTTGACACGCTGACT | 60 | 1803 |
| 1065732 | 465880 | 465899 | GTACTCTTGCCCATGGATGG | 42 | 1804 |
| 1065748 | 466292 | 466311 | CCCCTGTGGCTTATAGGTGG | 93 | 1805 |
| 1065764 | 466995 | 467014 | GGATGAACCTGCTTCACACA | 45 | 1806 |
| 1065780 | 468051 | 468070 | CAGATTTGCCAGGTAAAGCG | 58 | 1807 |
| 1065796 | 470320 | 470339 | AACTATCCTGCATCCGAGGC | 33 | 1808 |
| 1065812 | 474393 | 474412 | GGTCAACCAATTTGCTATTC | 23 | 1809 |
| 1065828 | 475722 | 475741 | GGTCTTGGGATTATAGTTTG | 32 | 1810 |
| 1065844 | 476155 | 476174 | GGAGTTCCTAACTCTCAATC | 78 | 1811 |
| 1065860 | 478826 | 478845 | TCTACTGAGGAACCCATCAC | 86 | 1812 |
| 1065876 | 480715 | 480734 | CGTTGCATAACATGTGTATT | 46 | 1813 |
| 1065892 | 482259 | 482278 | TACACCTGCAACAAGCCATC | 85 | 1814 |
| 1065908 | 483816 | 483835 | GAGCAAATCGGCAAAGGCAT | 43 | 1815 |
| 1065923 | 484156 | 484175 | CCAAGTGGCTTGTGGTGAAA | 87 | 1816 |
| 1065939 | 485817 | 485836 | GAACTACGAATAATTGCATG | 49 | 1817 |
| 1065955 | 487610 | 487629 | CAATGGTTTAGTGTCATATG | 27 | 1818 |
| 1065971 | 489454 | 489473 | AGTAGCTGTTTAGGCTGGAC | 58 | 1819 |
| 1065987 | 489784 | 489803 | TTGCCCTGCCACTCCCGTGG | 76 | 1820 |
| 1066003 | 494419 | 494438 | GGGATATATCACTTGGAGCT | ND | 1821 |
| 1066019 | 496833 | 496852 | CAGATTAGGTATGGAGGCCA | 49 | 1822 |
| 1066035 | 498902 | 498921 | ACGGATTAGATTCTCCAACA | 36 | 1823 |
| 1066051 | 499936 | 499955 | AGGACACATCAAGCTAGCTA | 55 | 1824 |
| 1066067 | 500680 | 500699 | AAGCCCTTTGCTTTTTCGGG | 81 | 1825 |
| 1066083 | 500908 | 500927 | GTGTTTTGACCTAACTGGCC | 65 | 1826 |
| 1066099 | 501472 | 501491 | CGTGGGTATGGTTTTCCTCT | 75 | 1827 |
| 1066115 | 501905 | 501924 | TCCAACGAGTGATAATTCAC | 81 | 1828 |
| 1066131 | 502423 | 502442 | AATTGATGCATAAGTAAGGC | 51 | 1829 |
| 1066147 | 502762 | 502781 | ATAGGCACTTCGGGCAAATA | 67 | 1830 |
| 1066163 | 503043 | 503062 | GGATTTAGGTGCTACAGTCA | 38 | 1831 |

TABLE 26-continued

Reduction of UBE3A-ATS RNA by 7,000 nM 5-10-5 MOE gapmers with mixed PO/PS internucleoside linkages in vitro (37,000 cells/well)

| Compound Number | SEQ ID NO: 1 Start Site | SEQ ID NO: 1 Stop Site | Sequence (5' to 3') | UBE3A-ATS (% UTC) | SEQ ID NO |
|---|---|---|---|---|---|
| 1066179 | 503356 | 503375 | GTTAGCCCAGGTGATCAGCT | 57 | 1832 |
| 1066195 | 503886 | 503905 | ATTGCAACTAATAAAGGGTC | 79 | 1833 |
| 1066211 | 504295 | 504314 | GCTCTCATGTGAGAGTATGA | 81 | 1834 |
| 1066227 | 504544 | 504563 | TCATGAATTCAGGTTGCCCC | 42 | 1835 |
| 1066243 | 505149 | 505168 | CTTTGGTTGGAAGTTAGACC | 46 | 1836 |
| 1066259 | 505666 | 505685 | CTGCTTATTGCAGGCCTAGC | 69 | 1837 |
| 1066275 | 506042 | 506061 | CAGTTGAGAACGGTATTGAG | 67 | 1838 |
| 1066291 | 506447 | 506466 | GTCTGTCTTTAGGGTCACCC | 47 | 1839 |
| 1066307 | 506828 | 506847 | GCTTTAGGATGGTGTGGATC | 60 | 1840 |
| 1066323 | 507587 | 507606 | CTCTCACTGACTAGCTTTCG | 57 | 1841 |
| 1066339 | 508114 | 508133 | CTTACCGTCTTTAGGAACTT | 47 | 1842 |
| 1066355 | 508585 | 508604 | GGACAGCACAACCCCGTGC | 94 | 1843 |
| 1066371 | 509070 | 509089 | CCCTACAATGCATACCCAAC | 58 | 1844 |
| 1066387 | 510027 | 510046 | GAGTTATACACGGAACCCAC | 56 | 1845 |
| 1066403 | 510410 | 510429 | GTCCAAGACATGCTAGGGAC | 71 | 1846 |
| 1066419 | 510839 | 510858 | CAATCTAGTTAGACCAGGCA | 31 | 1847 |
| 1066435 | 511667 | 511686 | ATGGACTGCCGGCCTGGAGC | 49 | 1848 |
| 1066451 | 511894 | 511913 | GTGAACTACTTGGAGACCTT | 50 | 1849 |

TABLE 27

Reduction of UBE3A-ATS RNA by 7,000 nM 5-10-5 MOE gapmers with mixed PO/PS internucleoside linkages in vitro (37,000 cells/well)

| Compound Number | SEQ ID NO: 1 Start Site | SEQ ID NO: 1 Stop Site | Sequence (5' to 3') | UBE3A-ATS (% UTC) | SEQ ID NO |
|---|---|---|---|---|---|
| 617557 | 483977 | 483996 | ATCATGTGCATACCCAGGGT | 31 | 172 |
| 749882 | 460115 | 460134 | ACTTTATAGTGTGGATGGTA | 17 | 586 |
| 750519 | 349103# | 349122# | GTCATCACCTCTCTTCAGGA | 16 | 181 |
| 1065273 | 432754 | 432773 | ACGCAACTGAGACAATCCAT | 33 | 1850 |
| 1065289 | 440229 | 440248 | GTGGCTGTGCTGGATATTAC | 48 | 1851 |
| 1065305 | 442574 | 442593 | GAGCAAAATGGTCAGTACCC | 43 | 1852 |
| 1065321 | 443357 | 443376 | GATAGGTCAGTCACTCACTG | 40 | 1853 |
| 1065337 | 444867 | 444886 | GGATGCATTGGTGTCAAGAG | 47 | 1854 |
| 1065353 | 445763 | 445782 | GGTTTACACATGATAGGAAC | 80 | 1855 |
| 1065369 | 446772 | 446791 | AACAACGGTTGCAGGGACAG | 29 | 1856 |
| 1065385 | 447787 | 447806 | CCCCGTGTACAGTAAGGGCC | 73 | 1857 |
| 1065401 | 448408 | 448427 | GTCTTAGTGCCAAATATCCA | 52 | 1858 |

TABLE 27-continued

Reduction of UBE3A-ATS RNA by 7,000 nM 5-10-5 MOE gapmers with mixed PO/PS internucleoside linkages in vitro (37,000 cells/well)

| Compound Number | SEQ ID NO: 1 Start Site | SEQ ID NO: 1 Stop Site | Sequence (5' to 3') | UBE3A-ATS (% UTC) | SEQ ID NO |
|---|---|---|---|---|---|
| 1065417 | 448735 | 448754 | TATTTAGACCACGATAACTG | 100 | 1859 |
| 1065433 | 449118 | 449137 | TCCCTCTTGTAGATCCTGGC | 40 | 1860 |
| 1065449 | 449666 | 449685 | GAGATATGATTAGTACTGGA | 63 | 1861 |
| 1065465 | 452079 | 452098 | GAGATAGAACACTTCGCCGC | 39 | 1862 |
| 1065481 | 453032 | 453051 | GTGATTAGGCGGCCGGGCGC | 119 | 1863 |
| 1065497 | 454151 | 454170 | CTTATGGAGACTTATATACC | 61 | 1864 |
| 1065513 | 454842 | 454861 | GGGTAGAAGACTAGCATACA | 22 | 1865 |
| 1065529 | 455233 | 455252 | GTACTTATCCTTGATCCAGA | 48 | 1866 |
| 1065545 | 455636 | 455655 | AGCACAAGATTGGTTCCATT | 47 | 1867 |
| 1065561 | 456827 | 456846 | GGGTACTATGTTGTCACTGA | N.D | 1868 |
| 1065577 | 457571 | 457590 | ATGAACCATGGAGTCTCTAT | 77 | 1869 |
| 1065593 | 458456 | 458475 | GGCTTTATACTTTACCCAAC | 15 | 1870 |
| 1065609 | 459265 | 459284 | GTAGATAACTTTACCTTGAC | 14 | 1871 |
| 1065625 | 460511 | 460530 | GTTTATAGGGTGGTTGGTTC | N.D. | 1872 |
| 1065641 | 461413 | 461432 | GGGTTACTTTCCAATAGAGT | 11 | 1873 |
| 1065656 | 461610 | 461629 | AGGCATGTACAAACGGGCTA | 73 | 1874 |
| 1065671 | 463193 | 463212 | GTTCTGGAATCTTGTAGAGG | 11 | 1875 |
| 1065686 | 464398 | 464417 | CCCATTCAGCACTTAGGTAG | 23 | 1876 |
| 1065701 | 465011 | 465030 | CTGCTCAAATCTGCGAATAG | 73 | 1877 |
| 1065717 | 465374 | 465393 | GAGGATGGTGTGTATGTTAT | 31 | 1878 |
| 1065733 | 465889 | 465908 | TCCCACAAGGTACTCTTGCC | 61 | 1879 |
| 1065749 | 466296 | 466315 | GCATCCCTGTGGCTTATAG | 65 | 1880 |
| 1065765 | 467043 | 467062 | TCAGTTAGTCAGGTTAGGGA | 7 | 1881 |
| 1065781 | 468335 | 468354 | AGCTATTGCAGCTATGGGTT | 35 | 1882 |
| 1065797 | 470401 | 470420 | GTTCAACCATCGAGATGATC | 64 | 1883 |
| 1065813 | 474404 | 474423 | GATAGGGTTTAGGTCAACCA | 20 | 1884 |
| 1065829 | 475726 | 475745 | ATCTGGTCTTGGGATTATAG | 26 | 1885 |
| 1065845 | 476159 | 476178 | CTTAGGAGTTCCTAACTCTC | 56 | 1886 |
| 1065861 | 478935 | 478954 | GTTTTGGAGATTGTGTTACG | 57 | 1887 |
| 1065877 | 480733 | 480752 | GGAGCCAGGTAGAGTTAACG | 41 | 1888 |
| 1065893 | 482489 | 482508 | GGATAGTTGTGAACAACTTC | 70 | 1889 |
| 1065909 | 483839 | 483858 | CATTGAATGAGGGCCCAAAC | 77 | 1890 |
| 1065924 | 484241 | 484260 | GGACTTGTCTTATGGCTGCC | N.D. | 1891 |
| 1065940 | 485829 | 485848 | TGATTATTCAGAGAACTACG | 47 | 1892 |
| 1065956 | 487697 | 487716 | CGTTGGCATTTAAGTCTGAG | 35 | 1893 |
| 1065972 | 489491 | 489510 | CTGGGTTGAGACTATTCAGG | 64 | 1894 |

TABLE 27-continued

Reduction of UBE3A-ATS RNA by 7,000 nM 5-10-5 MOE gapmers with mixed PO/PS internucleoside linkages in vitro (37,000 cells/well)

| Compound Number | SEQ ID NO: 1 Start Site | SEQ ID NO: 1 Stop Site | Sequence (5' to 3') | UBE3A-ATS (% UTC) | SEQ ID NO |
|---|---|---|---|---|---|
| 1065988 | 489844 | 489863 | CCATTGAAGAAAAACCCGCG | 52 | 1895 |
| 1066004 | 494452 | 494471 | GCACTACTGTAAGGGTCATG | 48 | 1896 |
| 1066020 | 497158 | 497177 | ACAAGGGTAGTGTTACACTG | 42 | 1897 |
| 1066036 | 499081 | 499100 | CAATGGTAATCGCATATACT | 53 | 1898 |
| 1066052 | 500210 | 500229 | GACTAATCCTCTTAAGTTCA | 45 | 1899 |
| 1066068 | 500689 | 500708 | AGGTACTGTAAGCCCTTTGC | 80 | 1900 |
| 1066084 | 500972 | 500991 | AACTTTTACACGCTAGTGGG | 68 | 1901 |
| 1066100 | 501490 | 501509 | CCCTTTGTTCATACTGAACG | 69 | 1902 |
| 1066116 | 501913 | 501932 | AGCTTCCCTCCAACGAGTGA | 78 | 1903 |
| 1066132 | 502433 | 502452 | GGCCCAAGGGAATTGATGCA | 45 | 1904 |
| 1066148 | 502766 | 502785 | AGGAATAGGCACTTCGGGCA | 58 | 1905 |
| 1066164 | 503051 | 503070 | GGAACCCAGGATTTAGGTGC | 50 | 1906 |
| 1066180 | 503368 | 503387 | GGTCATAGGAGTGTTAGCCC | 44 | 1907 |
| 1066196 | 503900 | 503919 | GGTTGGATTGCTTTATTGCA | 85 | 1908 |
| 1066212 | 504299 | 504318 | GCCTGCTCTCATGTGAGAGT | 47 | 1909 |
| 1066228 | 504644 | 504663 | CGCTTGGCTGACATTTAGGG | 38 | 1910 |
| 1066244 | 505169 | 505188 | ACCGAGCTCAAGAACTGTGA | 59 | 1911 |
| 1066260 | 505670 | 505689 | TGGCCTGCTTATTGCAGGCC | 73 | 1912 |
| 1066276 | 506047 | 506066 | GTTTTCAGTTGAGAACGGTA | 41 | 1913 |
| 1066292 | 506493 | 506512 | GGGACCTCCTTATATTCACC | 35 | 1914 |
| 1066308 | 506833 | 506852 | CCCCTGCTTTAGGATGGTGT | 134 | 1915 |
| 1066324 | 507637 | 507656 | GGTCCCCCCAGAAGGCTTGA | 56 | 1916 |
| 1066340 | 508118 | 508137 | TATTCTTACCGTCTTTAGGA | 39 | 1917 |
| 1066356 | 508640 | 508659 | GGATGGAGCTGTTGTGGCAT | 57 | 1918 |
| 1066372 | 509076 | 509095 | GCATTACCCTACAATGCATA | 84 | 1919 |
| 1066388 | 510035 | 510054 | GCATTTGAGAGTTATACACG | 33 | 1920 |
| 1066404 | 510596 | 510615 | GGGCCTTATAGACCATACCA | 65 | 1921 |
| 1066420 | 510844 | 510863 | GGAGACAATCTAGTTAGACC | 30 | 1922 |
| 1066436 | 511673 | 511692 | GCACAAATGGACTGCCGGCC | 89 | 1923 |
| 1066452 | 511964 | 511983 | GAGAGTCATACTCCTGACAG | 53 | 1924 |

TABLE 28

Reduction of UBE3A-ATS RNA by 7,000 nM 5-10-5 MOE gapmers with mixed PO/PS internucleoside linkages in vitro (37,000 cells/well)

| Compound Number | SEQ ID NO: 1 Start Site | SEQ ID NO: 1 Stop Site | Sequence (5' to 3') | UBE3A-ATS (% UTC) | SEQ ID NO |
|---|---|---|---|---|---|
| 617557 | 483977 | 483996 | ATCATGTGCATACCCAGGGT | 24 | 172 |
| 749882 | 460115 | 460134 | ACTTTATAGTGTGGATGGTA | 27 | 586 |
| 750519 | 349103# | 349122# | GTCATCACCTCTCTTCAGGA | 7 | 181 |
| 1065262 | 430574 | 430593 | CTCCGGGCTCACCACCTGT | 82 | 1925 |
| 1065278 | 433033 | 433052 | TCTATACACTGCTGTTGACG | 52 | 1926 |
| 1065294 | 441732 | 441751 | GCTTGCTAAACCTGTCCATT | 40 | 1927 |
| 1065310 | 442717 | 442736 | CTGGATGGTATAAATTGCCC | 43 | 1928 |
| 1065326 | 443811 | 443830 | GTTGCCGCTTTGGTGAACCT | 69 | 1929 |
| 1065342 | 445129 | 445148 | GTGCACTGATACAGTTGGGC | 31 | 1930 |
| 1065358 | 446360 | 446379 | CCATCAAGTAGGCCAGTCAC | 37 | 1931 |
| 1065374 | 446952 | 446971 | GGAATAACCCATACCCCCCA | 97 | 1932 |
| 1065390 | 447883 | 447902 | GCATGACTCCTAATTGCTGT | 59 | 1933 |
| 1065406 | 448539 | 448558 | GAGCTCAGTCTTCACTAGTT | 46 | 1934 |
| 1065422 | 448919 | 448938 | GTCAGGCACCAGATTGCTCA | 70 | 1935 |
| 1065438 | 449442 | 449461 | ATGATCATACTGGAGCCAGG | 8 | 1936 |
| 1065454 | 449875 | 449894 | ACCTACCAGAGTGGCATCCT | 47 | 1937 |
| 1065470 | 452250 | 452269 | ACGCTGTGTGAATCAAAAGC | 85 | 1938 |
| 1065486 | 453211 | 453230 | AGTGTTCTTACATCCACCGT | 62 | 1939 |
| 1065502 | 454279 | 454298 | CATGCCAATCGCATGCAAGC | 71 | 1940 |
| 1065518 | 454967 | 454986 | GTCAGGAGTTAACTATGAAC | 95 | 1941 |
| 1065534 | 455326 | 455345 | CACCAGTTAGGCCTGCTCCG | 94 | 1942 |
| 1065550 | 456651 | 456670 | CGTTTCCACAGCCAGGCTTA | 83 | 1943 |
| 1065566 | 456921 | 456940 | AGTCTTGGGTCACTAGGCAC | 81 | 1944 |
| 1065582 | 457908 | 457927 | CCAATATTTTGACTAGTTCG | 23 | 1945 |
| 1065598 | 458568 | 458587 | TTTAGTATGTCGAGAACTCA | 31 | 1946 |
| 1065614 | 459652 | 459671 | TGAAACCTGTATAGTTTACC | 70 | 1947 |
| 1065630 | 460652 | 460671 | CTAACCATAGACAGAGTGCA | 33 | 1948 |
| 1065645 | 461463 | 461482 | CATCATGATCTTGGTAAGGC | 18 | 1949 |
| 1065661 | 461898 | 461917 | GACCCCACAATTTGGTCCCA | 62 | 1950 |
| 1065676 | 463668 | 463687 | GACTATCTCAGCACTAGGGA | 26 | 1951 |
| 1065691 | 464558 | 464577 | GCCCTGTAGTATGTGGATAC | 46 | 1952 |
| 1065706 | 465231 | 465250 | CTCGGGTATATAAATTAATG | 43 | 1953 |
| 1065722 | 465480 | 465499 | GGATCTAGAATGATTGGTTG | 75 | 1954 |
| 1065738 | 466218 | 466237 | GGGCTGCTGTTTGAGTCCCC | 65 | 1955 |
| 1065754 | 466397 | 466416 | AGATACTCACTCGCTTTTCA | 20 | 1956 |
| 1065770 | 467416 | 467435 | ACGCTCCTTCATTTCATGCA | 46 | 1957 |
| 1065786 | 468925 | 468944 | GCTGTAAGTATAGATGCCTC | 35 | 1958 |

TABLE 28-continued

Reduction of UBE3A-ATS RNA by 7,000 nM 5-10-5 MOE gapmers with mixed PO/PS internucleoside linkages in vitro (37,000 cells/well)

| Compound Number | SEQ ID NO: 1 Start Site | SEQ ID NO: 1 Stop Site | Sequence (5' to 3') | UBE3A-ATS (% UTC) | SEQ ID NO |
|---|---|---|---|---|---|
| 1065802 | 472661 | 472680 | ATTAGTTGACTCTATAAACG | 70 | 1959 |
| 1065818 | 474805 | 474824 | AAGTTTGGTATTGACACCTC | 36 | 1960 |
| 1065834 | 475858 | 475877 | CTTGATATAAGGGTAATACG | 58 | 1961 |
| 1065850 | 476393 | 476412 | GGCTCAGGCAAAGTAGCTTC | 93 | 1962 |
| 1065866 | 479584 | 479603 | GCCATCTTCAAGACTAAGGT | 50 | 1963 |
| 1065882 | 480932 | 480951 | CGAAAATAGTATGCGAAGC | 32 | 1964 |
| 1065898 | 482792 | 482811 | GGAGACCCTAAAAAACCCGT | 67 | 1965 |
| 1065914 | 483913 | 483932 | CCTATAGGTGGCCTTCAGTC | 30 | 1966 |
| 1065929 | 484322 | 484341 | GGCAAGCCCAGACTCATGCT | 86 | 1967 |
| 1065945 | 486491 | 486510 | CGTCAACACTATAGATGAAT | 40 | 1968 |
| 1065961 | 488332 | 488351 | CCACTCATGTACATGAGATC | 44 | 1969 |
| 1065977 | 489547 | 489566 | GGCAAGCAACTATGGGTGGA | 26 | 1970 |
| 1065993 | 493198 | 493217 | GTTTACTTCGGGCCAGGTCC | 97 | 1971 |
| 1066009 | 495221 | 495240 | ACCCCTAGGAATAATGTTGC | 36 | 1972 |
| 1066025 | 497750 | 497769 | AGCGATACAAACCTACGCCA | 71 | 1973 |
| 1066041 | 499146 | 499165 | GGCAAGTTTTTATCGCTTAA | 48 | 1974 |
| 1066057 | 500425 | 500444 | AGTATTTTAGCCGGGATACG | 53 | 1975 |
| 1066073 | 500846 | 500865 | ACGGGTTCCTATTTGTCAGG | 54 | 1976 |
| 1066089 | 501208 | 501227 | GTGAGCTTTACTCTGCAATA | 31 | 1977 |
| 1066105 | 501601 | 501620 | GCCTTATTGGAGAGAGAACT | 91 | 1978 |
| 1066121 | 502134 | 502153 | TCAGTGCTACCCATTAGACC | 35 | 1979 |
| 1066137 | 502512 | 502531 | CATACATGGAGGAGTCCCTG | 59 | 1980 |
| 1066153 | 502809 | 502828 | TCCTAAGGATGTAGCCCATC | 55 | 1981 |
| 1066169 | 503123 | 503142 | CGCATCCAGTTAATCTCTGA | 84 | 1982 |
| 1066185 | 503437 | 503456 | GTCCCAGTTGGATTAAGGTG | 64 | 1983 |
| 1066201 | 503970 | 503989 | CTGTACAGGAGGGTGTCTCT | N.D. | 1984 |
| 1066217 | 504426 | 504445 | TAGTCTAAGGCAGTCAGGGT | 28 | 1985 |
| 1066233 | 504757 | 504776 | ATCTAGACTCTGCCTGGTTA | 51 | 1986 |
| 1066249 | 505218 | 505237 | GGACACTCTCGCTGAGGACA | 21 | 1987 |
| 1066265 | 505800 | 505819 | GGCACTATGACCACAGGGTA | 35 | 1988 |
| 1066281 | 506127 | 506146 | TCTGCTCTGTTAGCCGAGCA | 77 | 1989 |
| 1066297 | 506641 | 506660 | GCACAATGCTTGTATGCCCC | 57 | 1990 |
| 1066313 | 507239 | 507258 | GTGCCCTTACTGTTAAATCC | 48 | 1991 |
| 1066329 | 507766 | 507785 | TTTGCTCAGGATCGCTGGCC | 93 | 1992 |
| 1066345 | 508230 | 508249 | AGCCTCTGCCTAAAGGTAGT | 64 | 1993 |
| 1066361 | 508780 | 508799 | CGTGATTGCAAAGTCCAAGG | 47 | 1994 |

TABLE 28-continued

Reduction of UBE3A-ATS RNA by 7,000 nM 5-10-5 MOE gapmers with mixed PO/PS internucleoside linkages in vitro (37,000 cells/well)

| Compound Number | SEQ ID NO: 1 Start Site | SEQ ID NO: 1 Stop Site | Sequence (5' to 3') | UBE3A-ATS (% UTC) | SEQ ID NO |
|---|---|---|---|---|---|
| 1066377 | 509247 | 509266 | CAGTAGTGGTATCAAATCTG | 36 | 1995 |
| 1066393 | 510133 | 510152 | TCCAGCACATAGACCATAGC | 60 | 1996 |
| 1066409 | 510676 | 510695 | GGTGGAAAGTCTAGTATGTC | 73 | 1997 |
| 1066425 | 511077 | 511096 | GACCCATGGAAAGACTCGGG | 119 | 1998 |
| 1066441 | 511737 | 511756 | GTTTCCCATAGGCCACGCTG | 81 | 1999 |

TABLE 29

Reduction of UBE3A-ATS RNA by 7,000 nM 5-10-5 MOE gapmers with mixed PO/PS internucleoside linkages in vitro (37,000 cells/well)

| Compound Number | SEQ ID NO: 1 Start Site | SEQ ID NO: 1 Stop Site | Sequence (5' to 3') | UBE3A-ATS (% UTC) | SEQ ID NO |
|---|---|---|---|---|---|
| 617557 | 483977 | 483996 | ATCATGTGCATACCCAGGGT | 35 | 172 |
| 749882 | 460115 | 460134 | ACTTTATAGTGTGGATGGTA | 26 | 586 |
| 749935 | 463695 | 463714 | AGTGGTTGCTATCCTGCTAA | 65 | 2000 |
| 750519 | 349103# | 349122# | GTCATCACCTCTCTTCAGGA | 16 | 181 |
| 1065263 | 430586 | 430605 | ACGCAAGTCCTCCTCCGGGC | 73 | 2001 |
| 1065279 | 433138 | 433157 | TCAAGGGAACTAACTCCTCC | 91 | 2002 |
| 1065295 | 441764 | 441783 | GATTGATCATGTTATGCCCT | 34 | 2003 |
| 1065311 | 442754 | 442773 | GGTGGATTGGAGTTGCTACA | 74 | 2004 |
| 1065327 | 443823 | 443842 | TGGGACACATATGTTGCCGC | 81 | 2005 |
| 1065343 | 445173 | 445192 | CTGAAGCAAAGCTTATAGGC | 91 | 2006 |
| 1065359 | 446483 | 446502 | TGACACTGAGTAATCTGCGA | 71 | 2007 |
| 1065375 | 446994 | 447013 | TGTAAGATTCCCCCAAGGGT | 103 | 2008 |
| 1065391 | 447907 | 447926 | GGTGGGATTACATCTCTTAT | 97 | 2009 |
| 1065407 | 448582 | 448601 | CGTGATATTCATGTTGTCTG | 89 | 2010 |
| 1065423 | 448947 | 448966 | CGAAGCCAAAGGTACTTGAG | 100 | 2011 |
| 1065439 | 449461 | 449480 | GCTTGCACTCCATCATATAA | 126 | 2012 |
| 1065455 | 449988 | 450007 | AGGACCAGCCAGTCTAGTTT | 47 | 2013 |
| 1065471 | 452256 | 452275 | GGTCTCACGCTGTGTGAATC | 90 | 2014 |
| 1065487 | 453229 | 453248 | GGAGTCAAGTTGGTTAATAG | 136 | 2015 |
| 1065503 | 454339 | 454358 | GGGCGAAAGTATATCAGGCA | N.D. | 2016 |
| 1065519 | 455012 | 455031 | GGCTGTCAATGCTGATATAT | 82 | 2017 |
| 1065535 | 455332 | 455351 | GGAGTTCACCAGTTAGGCCT | 88 | 2018 |
| 1065551 | 456669 | 456688 | ACCCTCCCAACAAATAAGCG | 160 | 2019 |
| 1065567 | 456925 | 456944 | AGCAAGTCTTGGGTCACTAG | 72 | 2020 |
| 1065583 | 457969 | 457988 | GGCATCAATCAACAAGCACC | 49 | 2021 |

TABLE 29-continued

Reduction of UBE3A-ATS RNA by 7,000 nM 5-10-5 MOE gapmers with mixed PO/PS internucleoside linkages in vitro (37,000 cells/well)

| Compound Number | SEQ ID NO: 1 Start Site | SEQ ID NO: 1 Stop Site | Sequence (5' to 3') | UBE3A-ATS (% UTC) | SEQ ID NO |
|---|---|---|---|---|---|
| 1065599 | 458570 | 458589 | GCTTTAGTATGTCGAGAACT | 19 | 2022 |
| 1065615 | 460105 | 460124 | GTGGATGGTATCCTGGTCAA | 46 | 2023 |
| 1065631 | 460660 | 460679 | GCATGATTCTAACCATAGAC | 31 | 2024 |
| 1065646 | 461468 | 461487 | GTACTCATCATGATCTTGGT | 26 | 2025 |
| 1065662 | 462030 | 462049 | GGAATAGGGCTCTGCTTATT | 60 | 2026 |
| 1065692 | 464776 | 464795 | CCTCGAGGATAGTTTCACTG | 76 | 2027 |
| 1065707 | 465234 | 465253 | CATCTCGGGTATATAAATTA | 77 | 2028 |
| 1065723 | 465484 | 465503 | TGTTGGATCTAGAATGATTG | 71 | 2029 |
| 1065739 | 466222 | 466241 | GTATGGGCTGCTGTTTGAGT | 55 | 2030 |
| 1065755 | 466403 | 466422 | CTGCAGAGATACTCACTCGC | 55 | 2031 |
| 1065771 | 467421 | 467440 | TTGATACGCTCCTTCATTTC | 75 | 2032 |
| 1065787 | 468927 | 468946 | ATGCTGTAAGTATAGATGCC | 86 | 2033 |
| 1065803 | 472669 | 472688 | CGTTGAATATTAGTTGACTC | 74 | 2034 |
| 1065819 | 474875 | 474894 | GGTGTTGTATGATAATGTGT | 72 | 2035 |
| 1065835 | 475935 | 475954 | CAATAGTAGTGATGACTTCC | 41 | 2036 |
| 1065851 | 476439 | 476458 | AGATGGAGCTTGAGCCATCC | 76 | 2037 |
| 1065867 | 479607 | 479626 | GCCCCACAGTAGAAATGTGG | 87 | 2038 |
| 1065883 | 481338 | 481357 | AGTCAACAAGACAACTCGAT | 62 | 2039 |
| 1065899 | 482839 | 482858 | CGTTATTCAGTCTCAGGGAG | 28 | 2040 |
| 1065915 | 483919 | 483938 | CTTTCACCTATAGGTGGCCT | 67 | 2041 |
| 1065930 | 484442 | 484461 | GAGTAATGGACTTCTGGTCT | 133 | 2042 |
| 1065946 | 486772 | 486791 | GTGTGAGGGAATCTAAGATC | 54 | 2043 |
| 1065962 | 488566 | 488585 | GGTGCCACACCATCAAAGA | 63 | 2044 |
| 1065978 | 489581 | 489600 | GCTGCAGTGGTACCACAGAC | 91 | 2045 |
| 1065994 | 493203 | 493222 | AAGAAGTTTACTTCGGGCCA | 59 | 2046 |
| 1066010 | 495383 | 495402 | TCGGGAGTTGTTAGTCCAAG | 62 | 2047 |
| 1066026 | 497873 | 497892 | GCTCCCAAACAACTAATAGT | 76 | 2048 |
| 1066042 | 499204 | 499223 | TCAAAATCACGAAAGGCGGG | 71 | 2049 |
| 1066058 | 500430 | 500449 | TTAGAAGTATTTTAGCCGGG | 44 | 2050 |
| 1066074 | 500857 | 500876 | GGTAGGTAACTACGGGTTCC | 59 | 2051 |
| 1066090 | 501222 | 501241 | CACCCCTGTAAACAGTGAGC | 96 | 2052 |
| 1066106 | 501609 | 501628 | CTGCTCAAGCCTTATTGGAG | 120 | 2053 |
| 1066122 | 502140 | 502159 | GTGGAATCAGTGCTACCCAT | 77 | 2054 |
| 1066138 | 502527 | 502546 | AGCTGGGCACTCATACATAC | 55 | 2055 |
| 1066154 | 502813 | 502832 | AGCCTCCTAAGGATGTAGCC | 108 | 2056 |
| 1066170 | 503131 | 503150 | ATGGTCCTCGCATCCAGTTA | 54 | 2057 |

TABLE 29-continued

Reduction of UBE3A-ATS RNA by 7,000 nM 5-10-5 MOE gapmers with mixed PO/PS internucleoside linkages in vitro (37,000 cells/well)

| Compound Number | SEQ ID NO: 1 Start Site | SEQ ID NO: 1 Stop Site | Sequence (5' to 3') | UBE3A-ATS (% UTC) | SEQ ID NO |
|---|---|---|---|---|---|
| 1066186 | 503444 | 503463 | CAGCACTGTCCCAGTTGGAT | 61 | 2058 |
| 1066202 | 503986 508752 | 504005 508771 | GTTGATTCACTGCACACTGT | 80 | 2059 |
| 1066218 | 504433 | 504452 | GGTATATTAGTCTAAGGCAG | 43 | 2060 |
| 1066234 | 504789 | 504808 | GCGAAGCCTTCTCAAAGACT | 92 | 2061 |
| 1066250 | 505323 | 505342 | GGGCCGCCTCTGTTATTGTG | 88 | 2062 |
| 1066266 | 505808 | 505827 | GAACTGTGGGCACTATGACC | 86 | 2063 |
| 1066282 | 506165 | 506184 | CCTTTGGAGCTTTGACTGGC | 76 | 2064 |
| 1066298 | 506677 | 506696 | CGATTTCCTGCCAGTGGCTG | 79 | 2065 |
| 1066314 | 507244 | 507263 | CTACTGTGCCCTTACTGTTA | 83 | 2066 |
| 1066330 | 507795 | 507814 | GAAGACTTAGGTCTCAAGCT | 62 | 2067 |
| 1066346 | 508274 | 508293 | GTAGTCATGTAGAACAGCAC | 78 | 2068 |
| 1066362 | 508784 | 508803 | CCACCGTGATTGCAAAGTCC | 69 | 2069 |
| 1066378 | 509252 | 509271 | GGGCACAGTAGTGGTATCAA | 22 | 2070 |
| 1066394 | 510203 | 510222 | AGAGCTGTCCTAAGGCAATT | 54 | 2071 |
| 1066410 | 510711 | 510730 | CTTGACATACAGGATAGGTG | 52 | 2072 |
| 1066426 | 511088 | 511107 | TTGGTAAATTAGACCCATGG | 110 | 2073 |
| 1066442 | 511744 | 511763 | GATGTATGTTTCCCATAGGC | 56 | 2074 |

TABLE 30

Reduction of UBE3A-ATS RNA by 8,000 nM 5-10-5 MOE gapmers with mixed PO/PS internucleoside linkages in vitro (20,000 cells/well)

| Compound Number | SEQ ID NO: 1 Start Site | SEQ ID NO: 1 Stop Site | Sequence (5' to 3') | UBE3A-ATS (% UTC) | SEQ ID NO |
|---|---|---|---|---|---|
| 617557 | 483977 | 483996 | ATCATGTGCATACCCAGGGT | 51 | 172 |
| 749882 | 460115 | 460134 | ACTTTATAGTGTGGATGGTA | 46 | 586 |
| 750519 | 349103# | 349122# | GTCATCACCTCTCTTCAGGA | 28 | 181 |
| 1165442 | 449002 | 449021 | AGGTCTTATTTACCATTGGC | 72 | 2377 |
| 1165447 | 449444 | 449463 | TAATGATCATACTGGAGCCA | 87 | 2378 |
| 1165449 | 452253 | 452272 | CTCACGCTGTGTGAATCAAA | 101 | 2379 |
| 1165455 | 452265 | 452284 | GGAAGTCTAGGTCTCACGCT | 88 | 2380 |
| 1165467 | 453362 | 453381 | CTACATAGGCACTCTACTAG | 96 | 2381 |
| 1165471 | 454154 | 454173 | ACCCTTATGGAGACTTATAT | 96 | 2382 |
| 1165477 | 454461 | 454480 | GACTCCACACACCTACTAGA | 97 | 2383 |
| 1165483 | 454578 | 454597 | CAAGCAAAGACTACACCGTG | 106 | 2384 |
| 1165487 | 454848 | 454867 | TATCCAGGGTAGAAGACTAG | 83 | 2385 |

TABLE 30-continued

Reduction of UBE3A-ATS RNA by 8,000 nM 5-10-5 MOE gapmers with mixed PO/PS internucleoside linkages in vitro (20,000 cells/well)

| Compound Number | SEQ ID NO: 1 Start Site | SEQ ID NO: 1 Stop Site | Sequence (5' to 3') | UBE3A-ATS (% UTC) | SEQ ID NO |
|---|---|---|---|---|---|
| 1165493 | 454861 | 454880 | GGTGTATATTCCCTATCCAG | 89 | 2386 |
| 1165499 | 455020 | 455039 | AGTGGGATGGCTGTCAATGC | 82 | 2387 |
| 1165510 | 220439 456808 | 220458 456827 | AGGGATCCCCAAATAGAGCC | 96 | 2388 |
| 1165516 | 457018 | 457037 | TCACAGTTGCTTGACCCTTA | 79 | 2389 |
| 1165522 | 457572 | 457591 | TATGAACCATGGAGTCTCTA | 69 | 2390 |
| 1165528 | 458791 | 458810 | TCCCTAATATAGGGCAGATG | 88 | 2391 |
| 1165534 | 458942 | 458961 | TATAGGACCTCAGGAGATTG | 52 | 2392 |
| 1165539 | 458950 | 458969 | TCAAGACCTATAGGACCTCA | 37 | 2393 |
| 1165546 | 459550 | 459569 | AAAGACTATCCTGGTATGAC | 65 | 2394 |
| 1165557 | 460735 | 460754 | GATTTGAGCCTGCTATGTCT | 16* | 2395 |
| 1165565 | 461525 | 461544 | ACATTCAGCTAGACTAGTTG | 58 | 2396 |
| 1165570 | 461901 | 461920 | TGAGACCCCACAATTTGGTC | 89 | 2397 |
| 1165572 | 464385 | 464404 | TAGGTAGTTCACAACTCTTC | 68 | 2398 |
| 1165582 | 464562 | 464581 | ATATGCCCTGTAGTATGTGG | 77 | 2399 |
| 1165587 | 465245 | 465264 | ATTTTATTGGTCATCTCGGG | 47 | 2400 |
| 1165592 | 465387 | 465406 | TGTCAGACTTATTGAGGATG | 67 | 2401 |
| 1165594 | 465891 | 465910 | ACTCCCACAAGGTACTCTTG | 84 | 2402 |
| 1165598 | 466249 | 466268 | AACTGGTAGGATCTATGGCA | 40 | 2403 |
| 1165603 | 467301 | 467320 | TTCACAGAGTAGTCTATTGG | 84 | 2404 |
| 1165609 | 468352 | 468371 | TGTAGTATGCATTGACAAGC | 58 | 2405 |
| 1165612 | 482161 | 482180 | GAGTTACAAGTGTCATATAC | 48 | 2406 |
| 1165618 | 483960 | 483979 | GGTAGGATTCATGGTCCAAA | 64 | 2407 |
| 1165625 | 485656 | 485675 | CCTAGGACCAGTTGGTTCAC | 99 | 2408 |
| 1165633 | 489492 | 489511 | ACTGGGTTGAGACTATTCAG | 68 | 2409 |
| 1165638 | 489521 | 489540 | CAATGGACCACCTAAGACCT | 104 | 2410 |
| 1165641 | 493854 | 493873 | CTAATCTATGCTGGGCCCCA | 89 | 2411 |
| 1165647 | 493864 | 493883 | GAGATTAGGCCTAATCTATG | 116 | 2412 |
| 1165653 | 496830 | 496849 | ATTAGGTATGGAGGCCATGT | 69 | 2413 |
| 1165664 | 499674 | 499693 | AAGGTAGCCCCAATACAGAT | 87 | 2414 |
| 1165668 | 500690 | 500709 | GAGGTACTGTAAGCCCTTTG | 115 | 2415 |
| 1165673 | 500906 | 500925 | GTTTTGACCTAACTGGCCTT | 86 | 2416 |
| 1165678 | 501567 | 501586 | CTAAGGAGTGCTCTTTGTGG | 59 | 2417 |
| 1165684 | 502371 | 502390 | AGGTATTAAGGCCCTTGGCC | 95 | 2418 |
| 1165690 | 502378 | 502397 | GTATACAAGGTATTAAGGCC | 69 | 2419 |
| 1165695 | 502449 | 502468 | TAGGCAGCTCTTTGTAGGCC | 82 | 2420 |
| 1165701 | 503155 | 503174 | AGTTCTGTATACACCATCCC | 51 | 2421 |

TABLE 30-continued

Reduction of UBE3A-ATS RNA by 8,000 nM 5-10-5 MOE gapmers with mixed PO/PS internucleoside linkages in vitro (20,000 cells/well)

| Compound Number | SEQ ID NO: 1 Start Site | SEQ ID NO: 1 Stop Site | Sequence (5' to 3') | UBE3A-ATS (% UTC) | SEQ ID NO |
|---|---|---|---|---|---|
| 1165707 | 503361 | 503380 | GGAGTGTTAGCCCAGGTGAT | 95 | 2422 |
| 1165713 | 503367 | 503386 | GTCATAGGAGTGTTAGCCCA | 84 | 2423 |
| 1165719 | 503421 | 503440 | GGTGATGACACCCCTACCAT | 106 | 2424 |
| 1165725 | 503507 | 503526 | GCCTTGGTTGTGGTGAAACC | 64 | 2425 |
| 1165729 | 504076 | 504095 | GTGAACTCCTGTGACTGATA | 52 | 2426 |
| 1165736 | 504431 | 504450 | TATATTAGTCTAAGGCAGTC | 47 | 2427 |
| 1165747 | 505173 | 505192 | GTGTACCGAGCTCAAGAACT | 51 | 2428 |
| 1165753 | 505181 | 505200 | CTGTCTCTGTGTACCGAGCT | 64 | 2429 |
| 1165766 | 505320 | 505339 | CCGCCTCTGTTATTGTGATA | 78 | 2430 |
| 1165772 | 505327 | 505346 | AATTGGGCCGCCTCTGTTAT | 74 | 2431 |
| 1165778 | 505542 | 505561 | AGTCAGGTACAGGTGTTGGA | 56 | 2432 |
| 1165783 | 505745 | 505764 | TGTAGGTTGACAGGACATGC | 64 | 2433 |
| 1165789 | 505821 | 505840 | GAGGGTGCTTAGTGAACTGT | 87 | 2434 |
| 1165795 | 505830 | 505849 | AAGACCTGTGAGGGTGCTTA | 87 | 2435 |
| 1165800 | 506448 | 506467 | AGTCTGTCTTTAGGGTCACC | 57 | 2436 |
| 1165806 | 507907 | 507926 | TAGCCATTCGATACCTGCTT | 76 | 2437 |
| 1165812 | 507914 | 507933 | TGCAGGATAGCCATTCGATA | 75 | 2438 |
| 1165823 | 508791 | 508810 | ATGAATGCCACCGTGATTGC | 94 | 2439 |
| 1165828 | 510228 | 510247 | AGTTGTGTCTGAGGGATATC | 64 | 2440 |
| 1165839 | 448411 | 448430 | AGGGTCTTAGTGCCAAATAT | 102 | 2441 |
| 1165852 | 455763 | 455782 | TACCAAAGTGGCTGCTCACC | 76 | 2442 |
| 1165854 | 460426 | 460445 | TAGCCCTTTCAGCACACTTC | 44 | 2443 |
| 1165856 | 461342 | 461361 | CTGGCAATATGTCAACCTTA | 55 | 2444 |
| 1165864 | 464515 | 464534 | AGTGCACAGATAATGACTAG | 91 | 2445 |
| 1165880 | 484240 | 484259 | GACTTGTCTTATGGCTGCCT | 90 | 2446 |
| 1165884 | 486440 | 486459 | CCTAATAGCACCAGAATAGT | 104 | 2447 |
| 1165891 | 499666 | 499685 | CCCAATACAGATTCAGTGGC | 89 | 2448 |
| 1165901 | 504818 | 504837 | TGAAGTAGTCCTGCCCTTTC | 86 | 2449 |
| 1165902 | 505216 | 505235 | ACACTCTCGCTGAGGACACA | 74 | 2450 |
| 1165908 | 506966 | 506985 | GGGCATTCAGTGCTCCCTCC | 106 | 2451 |

TABLE 31

Reduction of UBE3A-ATS RNA by 8,000 nM 5-10-5 MOE gapmers with mixed PO/PS internucleoside linkages in vitro (20,000 cells/well)

| Compound Number | SEQ ID NO: 1 Start Site | SEQ ID NO: 1 Stop Site | Sequence (5' to 3') | UBE3A-ATS (% UTC) | SEQ ID NO |
|---|---|---|---|---|---|
| 617557 | 483977 | 483996 | ATCATGTGCATACCCAGGGT | 53 | 172 |
| 749882 | 460115 | 460134 | ACTTTATAGTGTGGATGGTA | 50 | 586 |
| 750519 | 349103# | 349122# | GTCATCACCTCTCTTCAGGA | 31 | 181 |
| 1165439 | 448413 | 448432 | CAAGGGTCTTAGTGCCAAAT | 106 | 2452 |
| 1165444 | 449095 | 449114 | TATGCTAGTCACTCATTGAG | 113 | 2453 |
| 1165451 | 452258 | 452277 | TAGGTCTCACGCTGTGTGAA | 97 | 2454 |
| 1165457 | 452268 | 452287 | GAGGGAAGTCTAGGTCTCAC | 89 | 2455 |
| 1165468 | 453365 | 453384 | TAACTACATAGGCACTCTAC | 79 | 2456 |
| 1165473 | 454161 | 454180 | AGATTTGACCCTTATGGAGA | 115 | 2457 |
| 1165479 | 454465 | 454484 | AGTGGACTCCACACACCTAC | 108 | 2458 |
| 1165485 | 454843 | 454862 | AGGGTAGAAGACTAGCATAC | 96 | 22 |
| 1165489 | 454857 | 454876 | TATATTCCCTATCCAGGGTA | 92 | 2459 |
| 1165495 | 454865 | 454884 | GACAGGTGTATATTCCCTAT | 116 | 2460 |
| 1165505 | 456628 | 456647 | TGTGCATGGTTATCTAATGC | 74 | 2461 |
| 1165512 | 457013 | 457032 | GTTGCTTGACCCTTAATTCA | 108 | 2462 |
| 1165518 | 457022 | 457041 | CATATCACAGTTGCTTGACC | 132 | 2463 |
| 1165524 | 457984 | 458003 | TTGATCTATTATGAGGGCAT | 22 | 2464 |
| 1165530 | 458935 | 458954 | CCTCAGGAGATTGTACAACA | 47 | 2465 |
| 1165542 | 459545 | 459564 | CTATCCTGGTATGACTGTCA | 39 | 2466 |
| 1165548 | 460110 | 460129 | ATAGTGTGGATGGTATCCTG | 57 | 2467 |
| 1165553 | 460508 | 460527 | TATAGGGTGGTTGGTTCAAA | 29 | 2468 |
| 1165559 | 460844 | 460863 | ACCACACATATAGGCTAGCC | 39 | 2469 |
| 1165566 | 461527 | 461546 | GAACATTCAGCTAGACTAGT | 64 | 2470 |
| 1165574 | 464388 | 464407 | ACTTAGGTAGTTCACAACTC | 55 | 2471 |
| 1165579 | 464557 | 464576 | CCCTGTAGTATGTGGATACT | 97 | 2472 |
| 1165583 | 465239 | 465258 | TTGGTCATCTCGGGTATATA | 43 | 2473 |
| 1165589 | 465380 | 465399 | CTTATTGAGGATGGTGTGTA | 64 | 2474 |
| 1165605 | 467802 | 467821 | TCCCTCTTAGTGATTGGTGG | 80 | 2475 |
| 1165614 | 483844 | 483863 | CTAGGCATTGAATGAGGGCC | 93 | 2476 |
| 1165620 | 483962 | 483981 | AGGGTAGGATTCATGGTCCA | 95 | 2477 |
| 1165627 | 486353 | 486372 | TTAATAGACTGCGATTATAC | 100 | 2478 |
| 1165630 | 489097 | 489116 | TCCCTAAGCTTAGATATACC | 76 | 2479 |
| 1165634 | 489516 | 489535 | GACCACCTAAGACCTCAAGG | 73 | 2480 |
| 1165643 | 493860 | 493879 | TTAGGCCTAATCTATGCTGG | 84 | 2481 |
| 1165649 | 493866 | 493885 | ATGAGATTAGGCCTAATCTA | 108 | 2482 |
| 1165655 | 496832 | 496851 | AGATTAGGTATGGAGGCCAT | 85 | 2483 |

TABLE 31-continued

Reduction of UBE3A-ATS RNA by 8,000 nM 5-10-5 MOE gapmers with mixed PO/PS internucleoside linkages in vitro (20,000 cells/well)

| Compound Number | SEQ ID NO: 1 Start Site | SEQ ID NO: 1 Stop Site | Sequence (5' to 3') | UBE3A-ATS (% UTC) | SEQ ID NO |
|---|---|---|---|---|---|
| 1165660 | 499668 | 499687 | GCCCCAATACAGATTCAGTG | 94 | 2484 |
| 1165675 | 500909 | 500928 | GGTGTTTTGACCTAACTGGC | 81 | 2485 |
| 1165680 | 501762 | 501781 | GGCTAAGAGTCACCTGTATC | 85 | 2486 |
| 1165686 | 502373 | 502392 | CAAGGTATTAAGGCCCTTGG | 92 | 2487 |
| 1165691 | 502438 | 502457 | TTGTAGGCCCAAGGGAATTG | 105 | 2488 |
| 1165696 | 502451 | 502470 | GCTAGGCAGCTCTTTGTAGG | 65 | 2489 |
| 1165703 | 503357 | 503376 | TGTTAGCCCAGGTGATCAGC | 69 | 2490 |
| 1165709 | 503363 | 503382 | TAGGAGTGTTAGCCCAGGTG | 56 | 2491 |
| 1165715 | 503370 | 503389 | AGGGTCATAGGAGTGTTAGC | 65 | 2492 |
| 1165721 | 503424 | 503443 | TAAGGTGATGACACCCCTAC | 109 | 2493 |
| 1165726 | 503871 | 503890 | GGGTCAGTTGTGCAGTTGTT | 46 | 2494 |
| 1165738 | 504434 | 504453 | AGGTATATTAGTCTAAGGCA | 49 | 2495 |
| 1165743 | 504977 | 504996 | CTATTATCTTCTTAGGGTCG | 57 | 2496 |
| 1165749 | 505175 | 505194 | CTGTGTACCGAGCTCAAGAA | 65 | 2497 |
| 1165755 | 505198 | 505217 | CATCAGCTGTTAGCAGTCTG | 82 | 2498 |
| 1165760 | 505219 | 505238 | AGGACACTCTCGCTGAGGAC | 64 | 2499 |
| 1165768 | 505322 | 505341 | GGCCGCCTCTGTTATTGTGA | 91 | 2500 |
| 1165774 | 505329 | 505348 | GAAATTGGGCCGCCTCTGTT | 91 | 2501 |
| 1165779 | 505651 | 505670 | CTAGCTTCCACCTAAGAGCT | 111 | 2502 |
| 1165785 | 505750 | 505769 | AACTCTGTAGGTTGACAGGA | 78 | 2503 |
| 1165791 | 505824 | 505843 | TGTGAGGGTGCTTAGTGAAC | 77 | 2504 |
| 1165796 | 505836 | 505855 | CTGTCAAAGACCTGTGAGGG | 78 | 2505 |
| 1165808 | 507910 | 507929 | GGATAGCCATTCGATACCTG | 101 | 2506 |
| 1165814 | 508119 | 508138 | TTATTCTTACCGTCTTTAGG | 70 | 2507 |
| 1165825 | 509129 | 509148 | AGCTCATCACAACTGGGTGG | 86 | 2508 |
| 1165842 | 449667 | 449686 | AGAGATATGATTAGTACTGG | 105 | 2509 |
| 1165850 | 455030 | 455049 | GTGATATTGCAGTGGGATGG | 89 | 2510 |
| 1165853 | 458945 | 458964 | ACCTATAGGACCTCAGGAGA | 70 | 2511 |
| 1165857 | 461416 | 461435 | ACTGGGTTACTTTCCAATAG | 61 | 2512 |
| 1165861 | 463093 | 463112 | CAATTTACTTGATACAGGGC | 43 | 2513 |
| 1165869 | 465393 | 465412 | GTCAATTGTCAGACTTATTG | 54 | 2514 |
| 1165873 | 466100 | 466119 | GGGCCTGTATGTCTTGAGAA | 88 | 2515 |
| 1165874 | 467294 | 467313 | AGTAGTCTATTGGTGTTCCT | 68 | 2516 |
| 1165876 | 468356 | 468375 | ATACTGTAGTATGCATTGAC | 79 | 2517 |
| 1165882 | 484300 | 484319 | TTACTAGGGCCAGAGAATCC | 94 | 2518 |
| 1165889 | 493623 | 493642 | CAGATGACTAGCCTCCAAAC | 102 | 2519 |

TABLE 31-continued

Reduction of UBE3A-ATS RNA by 8,000 nM 5-10-5 MOE gapmers with mixed PO/PS internucleoside linkages in vitro (20,000 cells/well)

| Compound Number | SEQ ID NO: 1 Start Site | SEQ ID NO: 1 Stop Site | Sequence (5' to 3') | UBE3A-ATS (% UTC) | SEQ ID NO |
|---|---|---|---|---|---|
| 1165892 | 499910 | 499929 | GCATAATAGGAGGTCCTTAA | 46 | 2520 |
| 1165894 | 500764 | 500783 | GTCAAATCAATTTGTGCCAC | 72 | 2521 |
| 1165900 | 504422 | 504441 | CTAAGGCAGTCAGGGTAATG | 55 | 2522 |
| 1165905 | 506694 | 506713 | TTAAGAAGCTTGCCTTTCGA | 115 | 2523 |
| 1165909 | 507901 | 507920 | TTCGATACCTGCTTTTGTGA | 111 | 2524 |
| 1165914 | 511254 | 511273 | CTGATGATTTGTTGATTACC | 84 | 2525 |

TABLE 32

Reduction of UBE3A-ATS RNA by 8,000 nM 5-10-5 MOE gapmers with mixed PO/PS internucleoside linkages in vitro (20,000 cells/well)

| Compound Number | SEQ ID NO: 1 Start Site | SEQ ID NO: 1 Stop Site | Sequence (5' to 3') | UBE3A-ATS (% UTC) | SEQ ID NO |
|---|---|---|---|---|---|
| 617557 | 483977 | 483996 | ATCATGTGCATACCCAGGGT | 49 | 172 |
| 749882 | 460115 | 460134 | ACTTTATAGTGTGGATGGTA | 33 | 586 |
| 750519 | 349103# | 349122# | GTCATCACCTCTCTTCAGGA | 22 | 181 |
| 1165440 | 448459 | 448478 | ATAGTGCCAGTAGGACTTAC | 98 | 2526 |
| 1165445 | 449097 | 449116 | AGTATGCTAGTCACTCATTG | 68 | 2527 |
| 1165452 | 452259 | 452278 | CTAGGTCTCACGCTGTGTGA | 84 | 2528 |
| 1165458 | 452271 | 452290 | TATGAGGGAAGTCTAGGTCT | 64 | 2529 |
| 1165474 | 454162 | 454181 | AAGATTTGACCCTTATGGAG | 96 | 2530 |
| 1165480 | 454466 | 454485 | GAGTGGACTCCACACACCTA | 80 | 2531 |
| 1165490 | 454858 | 454877 | GTATATTCCCTATCCAGGGT | 93 | 2532 |
| 1165496 | 454866 | 454885 | TGACAGGTGTATATTCCCTA | 55 | 2533 |
| 1165501 | 455031 | 455050 | AGTGATATTGCAGTGGGATG | 77 | 2534 |
| 1165506 | 220320 456689 | 220339 456708 | CATCATCGATCCAAACAAGC | 102 | 2535 |
| 1165513 | 457015 | 457034 | CAGTTGCTTGACCCTTAATT | 76 | 2536 |
| 1165519 | 457364 | 457383 | ACATGGTGAGGGTCTCAATG | 33 | 2537 |
| 1165525 | 457986 | 458005 | ACTTGATCTATTATGAGGGC | 35 | 2538 |
| 1165531 | 458936 | 458955 | ACCTCAGGAGATTGTACAAC | 42 | 2539 |
| 1165536 | 458947 | 458966 | AGACCTATAGGACCTCAGGA | 28 | 2540 |
| 1165543 | 459546 | 459565 | ACTATCCTGGTATGACTGTC | 40 | 2541 |
| 1165549 | 460112 | 460131 | TTATAGTGTGGATGGTATCC | 49 | 2542 |
| 1165554 | 460509 | 460528 | TTATAGGGTGGTTGGTTCAA | 24 | 2543 |
| 1165560 | 460845 | 460864 | TACCACACATATAGGCTAGC | 43 | 2544 |
| 1165567 | 461671 | 461690 | CCTAAGGTGAAGTCTGTGTA | 58 | 2545 |

TABLE 32-continued

Reduction of UBE3A-ATS RNA by 8,000 nM 5-10-5 MOE gapmers with mixed PO/PS internucleoside linkages in vitro (20,000 cells/well)

| Compound Number | SEQ ID NO: 1 Start Site | SEQ ID NO: 1 Stop Site | Sequence (5' to 3') | UBE3A-ATS (% UTC) | SEQ ID NO |
|---|---|---|---|---|---|
| 1165575 | 464389 | 464408 | CACTTAGGTAGTTCACAACT | 59 | 2546 |
| 1165580 | 464559 | 464578 | TGCCCTGTAGTATGTGGATA | 69 | 2547 |
| 1165584 | 465241 | 465260 | TATTGGTCATCTCGGGTATA | 51 | 2548 |
| 1165595 | 466246 | 466265 | TGGTAGGATCTATGGCAGTT | 35 | 2549 |
| 1165600 | 467297 | 467316 | CAGAGTAGTCTATTGGTGTT | 83 | 2550 |
| 1165606 | 467803 | 467822 | CTCCCTCTTAGTGATTGGTG | 84 | 2551 |
| 1165610 | 468403 | 468422 | CCTACCCTTGCATGCTATGT | 88 | 2552 |
| 1165615 | 483850 | 483869 | GCCTGACTAGGCATTGAATG | 79 | 2553 |
| 1165622 | 484301 | 484320 | GTTACTAGGGCCAGAGAATC | 105 | 2554 |
| 1165628 | 486354 | 486373 | GTTAATAGACTGCGATTATA | 43 | 2555 |
| 1165631 | 489098 | 489117 | CTCCCTAAGCTTAGATATAC | 88 | 2556 |
| 1165635 | 489518 | 489537 | TGGACCACCTAAGACCTCAA | 73 | 139 |
| 1165644 | 493861 | 493880 | ATTAGGCCTAATCTATGCTG | 89 | 2557 |
| 1165650 | 493868 | 493887 | AGATGAGATTAGGCCTAATC | 136 | 2558 |
| 1165656 | 496834 | 496853 | ACAGATTAGGTATGGAGGCC | 57 | 2559 |
| 1165661 | 499670 | 499689 | TAGCCCCAATACAGATTCAG | 55 | 2560 |
| 1165666 | 499911 | 499930 | TGCATAATAGGAGGTCCTTA | 54 | 2561 |
| 1165670 | 500864 | 500883 | TACTTTTGGTAGGTAACTAC | 70 | 2562 |
| 1165676 | 500910 | 500929 | AGGTGTTTTGACCTAACTGG | 80 | 2563 |
| 1165681 | 501764 | 501783 | TGGGCTAAGAGTCACCTGTA | 109 | 2564 |
| 1165687 | 502374 | 502393 | ACAAGGTATTAAGGCCCTTG | 106 | 2565 |
| 1165692 | 502439 | 502458 | TTTGTAGGCCCAAGGGAATT | 119 | 2566 |
| 1165697 | 502740 | 502759 | GCCCGATGACACCAGCCACT | 61 | 2567 |
| 1165704 | 503358 | 503377 | GTGTTAGCCCAGGTGATCAG | 66 | 2568 |
| 1165710 | 503364 | 503383 | ATAGGAGTGTTAGCCCAGGT | 62 | 2569 |
| 1165716 | 503418 | 503437 | GATGACACCCCTACCATGGC | 63 | 2570 |
| 1165722 | 503425 | 503444 | TTAAGGTGATGACACCCCTA | 102 | 2571 |
| 1165727 | 503873 | 503892 | AAGGGTCAGTTGTGCAGTTG | 43 | 2572 |
| 1165733 | 504427 | 504446 | TTAGTCTAAGGCAGTCAGGG | 50 | 2573 |
| 1165739 | 504435 | 504454 | TAGGTATATTAGTCTAAGGC | 50 | 2574 |
| 1165744 | 505167 | 505186 | CGAGCTCAAGAACTGTGACT | 65 | 2575 |
| 1165750 | 505176 | 505195 | TCTGTGTACCGAGCTCAAGA | 41 | 2576 |
| 1165756 | 505199 | 505218 | ACATCAGCTGTTAGCAGTCT | 45 | 2577 |
| 1165761 | 505220 | 505239 | GAGGACACTCTCGCTGAGGA | 78 | 2578 |
| 1165769 | 505324 | 505343 | TGGGCCGCCTCTGTTATTGT | 79 | 2579 |
| 1165775 | 505331 | 505350 | TAGAAATTGGGCCGCCTCTG | 63 | 2580 |

TABLE 32-continued

Reduction of UBE3A-ATS RNA by 8,000 nM 5-10-5 MOE gapmers with mixed PO/PS internucleoside linkages in vitro (20,000 cells/well)

| Compound Number | SEQ ID NO: 1 Start Site | SEQ ID NO: 1 Stop Site | Sequence (5' to 3') | UBE3A-ATS (% UTC) | SEQ ID NO |
|---|---|---|---|---|---|
| 1165780 | 505652 | 505671 | CCTAGCTTCCACCTAAGAGC | 78 | 2581 |
| 1165786 | 505751 | 505770 | GAACTCTGTAGGTTGACAGG | 43 | 2582 |
| 1165792 | 505826 | 505845 | CCTGTGAGGGTGCTTAGTGA | 76 | 2583 |
| 1165797 | 506166 | 506185 | ACCTTTGGAGCTTTGACTGG | 90 | 2584 |
| 1165804 | 507902 | 507921 | ATTCGATACCTGCTTTTGTG | 95 | 2585 |
| 1165809 | 507911 | 507930 | AGGATAGCCATTCGATACCT | 70 | 2586 |
| 1165837 | 511896 | 511915 | AAGTGAACTACTTGGAGACC | 38 | 2587 |
| 1165843 | 449698 | 449717 | TGTATGGCTTATGCATGCTA | 75 | 2588 |
| 1165847 | 453368 | 453387 | TATTAACTACATAGGCACTC | 58 | 2589 |
| 1165848 | 454844 | 454863 | CAGGGTAGAAGACTAGCATA | 109 | 2590 |
| 1165858 | 461430 | 461449 | TTAGCACTTCTATAACTGGG | 40 | 2591 |
| 1165862 | 463776 | 463795 | ATAGATTGGGCTTTAGAGGT | 45 | 2592 |
| 1165867 | 465383 | 465402 | AGACTTATTGAGGATGGTGT | 47 | 2593 |
| 1165870 | 465563 | 465582 | TAGGACAAGTCTTATAGAGA | 48 | 2594 |
| 1165878 | 483974 | 483993 | ATGTGCATACCCAGGGTAGG | 58 | 2595 |
| 1165890 | 493850 | 493869 | TCTATGCTGGGCCCCAATTC | 87 | 2596 |
| 1165906 | 506772 | 506791 | AGGTTGTGGAGGTTGTTCCT | 72 | 2597 |
| 1165911 | 508171 | 508190 | ACCTGCAGTTATTTAGCCAT | 68 | 2598 |
| 1165912 | 509171 | 509190 | AACCTCCAAGTGCTTCAAGC | 60 | 2599 |

TABLE 33

Reduction of UBE3A-ATS RNA by 8,000 nM 5-10-5 MOE gapmers with mixed PO/PS internucleoside linkages in vitro (20,000 cells/well)

| Compound Number | SEQ ID NO: 1 Start Site | SEQ ID NO: 1 Stop Site | Sequence (5' to 3') | UBE3A-ATS (% UTC) | SEQ ID NO |
|---|---|---|---|---|---|
| 1065438 | 449442 | 449461 | ATGATCATACTGGAGCCAGG | 95 | 1936 |
| 1165509 | 220406 456775 | 220425 456794 | CTTATTTGTCCTATTGGAGG | 91 | 2600 |
| 1178377 | 220315 456684 | 220334 456703 | TCGATCCAAACAAGCACCCT | 98 | 2601 |
| 1178379 | 220318 456687 | 220337 456706 | TCATCGATCCAAACAAGCAC | 132 | 2602 |
| 1178384 | 456753 | 456772 | CGCACATCTGGACCTCAGAT | 98 | 2603 |
| 1178386 | 456755 | 456774 | GCCGCACATCTGGACCTCAG | 129 | 2604 |
| 1178388 | 456758 | 456777 | AGGGCCGCACATCTGGACCT | 115 | 2605 |
| 1178390 | 456760 | 456779 | GGAGGGCCGCACATCTGGAC | 70 | 2606 |
| 1178392 | 456762 | 456781 | TTGGAGGGCCGCACATCTGG | 106 | 2607 |

TABLE 33-continued

Reduction of UBE3A-ATS RNA by 8,000 nM 5-10-5 MOE gapmers with mixed PO/PS internucleoside linkages in vitro (20,000 cells/well)

| Compound Number | SEQ ID NO: 1 Start Site | SEQ ID NO: 1 Stop Site | Sequence (5' to 3') | UBE3A-ATS (% UTC) | SEQ ID NO |
|---|---|---|---|---|---|
| 1178394 | 456764 | 456783 | TATTGGAGGGCCGCACATCT | 123 | 2608 |
| 1178396 | 456766 | 456785 | CCTATTGGAGGGCCGCACAT | 136 | 2609 |
| 1178398 | 456769 | 456788 | TGTCCTATTGGAGGGCCGCA | 100 | 2610 |
| 1178400 | 456771 | 456790 | TTTGTCCTATTGGAGGGCCG | 104 | 2611 |
| 1178404 | 220455 456824 | 220474 456843 | TACTATGTTGTCACTGAGGG | 83 | 2612 |
| 1178406 | 220457 456826 | 220476 456845 | GGTACTATGTTGTCACTGAG | 68 | 2613 |
| 1178408 | 456864 | 456883 | TGCCCTCTTCGAAGAGATAG | 87 | 2614 |
| 1178411 | 456914 | 456933 | GGTCACTAGGCACACTAAAG | 87 | 2615 |
| 1178413 | 456916 | 456935 | TGGGTCACTAGGCACACTAA | 87 | 2616 |
| 1178415 | 456923 | 456942 | CAAGTCTTGGGTCACTAGGC | 93 | 2617 |
| 1178417 | 456926 | 456945 | AAGCAAGTCTTGGGTCACTA | 72 | 2618 |
| 1178418 | 457232 | 457251 | CTTAGCTACTCACCCCTGTT | 111 | 2619 |
| 1178420 | 457237 | 457256 | AATGGCTTAGCTACTCACCC | 79 | 104 |
| 1178422 | 457240 | 457259 | GATAATGGCTTAGCTACTCA | 77 | 2620 |
| 1178423 | 457286 | 457305 | CGACCTAAAGACCTAGCAAA | 55 | 2621 |
| 1178425 | 457289 | 457308 | AAACGACCTAAAGACCTAGC | 50 | 2622 |
| 1178426 | 457294 | 457313 | GTACAAAACGACCTAAAGAC | 77 | 2623 |
| 1178428 | 457574 | 457593 | ATTATGAACCATGGAGTCTC | 47 | 2624 |
| 1179735 | 448291 | 448310 | TCGCAATAAGATTCCATTGC | 106 | 2625 |
| 1179742 | 448305 | 448324 | GTGCAAAACAAGTTTCGCAA | 119 | 2626 |
| 1179745 | 448453 | 448472 | CCAGTAGGACTTACTAAATC | 79 | 2627 |
| 1179747 | 448455 | 448474 | TGCCAGTAGGACTTACTAAA | 99 | 2628 |
| 1179749 | 448457 | 448476 | AGTGCCAGTAGGACTTACTA | 76 | 2629 |
| 1179751 | 448630 | 448649 | GAGGATTGCATCACATGTGT | 118 | 2630 |
| 1179753 | 448715 | 448734 | TAGCGCATTGAGCAAAATTC | 75 | 2631 |
| 1179755 | 448717 | 448736 | TGTAGCGCATTGAGCAAAAT | 75 | 2632 |
| 1179757 | 448719 | 448738 | ACTGTAGCGCATTGAGCAAA | 83 | 2633 |
| 1179759 | 448722 | 448741 | ATAACTGTAGCGCATTGAGC | 103 | 2634 |
| 1179761 | 448724 | 448743 | CGATAACTGTAGCGCATTGA | 68 | 2635 |
| 1179763 | 448727 | 448746 | CCACGATAACTGTAGCGCAT | 91 | 2636 |
| 1179765 | 448730 | 448749 | AGACCACGATAACTGTAGCG | 84 | 2637 |
| 1179767 | 448732 | 448751 | TTAGACCACGATAACTGTAG | 104 | 2638 |
| 1179769 | 448734 | 448753 | ATTTAGACCACGATAACTGT | 114 | 2639 |
| 1179770 | 448737 | 448756 | TATATTTAGACCACGATAAC | 106 | 2640 |
| 1179772 | 448740 | 448759 | CTGTATATTTAGACCACGAT | 78 | 2641 |

TABLE 33-continued

Reduction of UBE3A-ATS RNA by 8,000 nM 5-10-5 MOE gapmers with mixed PO/PS internucleoside linkages in vitro (20,000 cells/well)

| Compound Number | SEQ ID NO: 1 Start Site | SEQ ID NO: 1 Stop Site | Sequence (5' to 3') | UBE3A-ATS (% UTC) | SEQ ID NO |
|---|---|---|---|---|---|
| 1179774 | 448828 | 448847 | AGGACCCTTAAGTCATAAAG | 75 | 2642 |
| 1179776 | 448834 | 448853 | ATTGCAAGGACCCTTAAGTC | 75 | 2643 |
| 1179778 | 448841 | 448860 | TATCCCAATTGCAAGGACCC | 131 | 2644 |
| 1179781 | 448948 | 448967 | ACGAAGCCAAAGGTACTTGA | 124 | 2645 |
| 1179783 | 449034 | 449053 | GCCCTGACTGTCATTCATAT | 86 | 2646 |
| 1179785 | 449037 | 449056 | ACGGCCCTGACTGTCATTCA | 98 | 2647 |
| 1179787 | 449039 | 449058 | GAACGGCCCTGACTGTCATT | 117 | 2648 |
| 1179789 | 449042 | 449061 | AAGGAACGGCCCTGACTGTC | 78 | 2649 |
| 1179791 | 449044 | 449063 | TGAAGGAACGGCCCTGACTG | 101 | 2650 |
| 1179793 | 449046 | 449065 | CCTGAAGGAACGGCCCTGAC | 108 | 2651 |
| 1179795 | 449049 | 449068 | TGGCCTGAAGGAACGGCCCT | 119 | 2652 |
| 1179797 | 449052 | 449071 | ATGTGGCCTGAAGGAACGGC | 76 | 2653 |
| 1179799 | 449058 | 449077 | ATAATCATGTGGCCTGAAGG | 104 | 2654 |
| 1179801 | 449060 | 449079 | CGATAATCATGTGGCCTGAA | 79 | 2655 |
| 1179803 | 449063 | 449082 | TAACGATAATCATGTGGCCT | 61 | 2656 |
| 1179805 | 449065 | 449084 | CATAACGATAATCATGTGGC | 81 | 2657 |
| 1179807 | 449101 | 449120 | GGCAAGTATGCTAGTCACTC | 73 | 2658 |
| 1179809 | 449103 | 449122 | CTGGCAAGTATGCTAGTCAC | 105 | 2659 |
| 1179811 | 449106 | 449125 | ATCCTGGCAAGTATGCTAGT | 83 | 2660 |
| 1179813 | 449108 | 449127 | AGATCCTGGCAAGTATGCTA | 103 | 2661 |
| 1179815 | 449110 | 449129 | GTAGATCCTGGCAAGTATGC | 68 | 2662 |
| 1179817 | 449115 | 449134 | CTCTTGTAGATCCTGGCAAG | 78 | 2663 |
| 1179818 | 449157 | 449176 | CAACATTATATCGATGCAAT | 89 | 2664 |
| 1179820 | 449160 | 449179 | TGTCAACATTATATCGATGC | 109 | 2665 |
| 1179822 | 449163 | 449182 | ACTTGTCAACATTATATCGA | 78 | 2666 |
| 1179825 | 448297 | 448316 | CAAGTTTCGCAATAAGATTC | 72 | 2667 |
| 1179833 | 456498 | 456517 | TTAGATTAAAATCTGGCCGG | 92 | 2668 |
| 1179834 | 456912 | 456931 | TCACTAGGCACACTAAAGTG | 107 | 2669 |
| 1179838 | 457298 | 457317 | AGATGTACAAAACGACCTAA | 99 | 2670 |
| 1179840 | 457386 | 457405 | TAAGGATTCAATAGTGTAGG | 34 | 2671 |
| 1179842 | 457503 | 457522 | GGCACACCTGGATTTCACTA | 12 | 2672 |
| 1179845 | 448416 | 448435 | GAGCAAGGGTCTTAGTGCCA | 108 | 2673 |
| 1179847 | 448625 | 448644 | TTGCATACATGTGTCAGTC | 102 | 2674 |
| 1179849 | 448843 | 448862 | TTTATCCCAATTGCAAGGAC | 86 | 2675 |

Example 2

Effect of 5-10-5 MOE Gapmer Modified Oligonucleotides on Human UBE3A-ATS RNA In Vitro, Single Dose Modified oligonucleotides complementary to human UBE3A-ATS nucleic acid were tested for their effect on UBE3A-ATS RNA levels in vitro.

The modified oligonucleotides in the tables below are 5-10-5 gapmers. The gapmers are 20 nucleosides in length, wherein the central gap segment consists of ten 2'-β-D-deoxynucleosides and the 5' and 3' wing segments each consists of five 2'-MOE nucleosides. The sugar motif for the gampers is (from 5' to 3'): eeeeedddddddddddeeeee; wherein 'd' represents a 2'-β-D-deoxyribosyl sugar moiety, and 'e' represents a 2'-MOE sugar moiety.

Each internucleoside linkage of Compound IDs 617456, 617457, 617460, 617461, and 617557 is a phosphorothioate internucleoside linkage. All other compounds have an internucleoside linkage motif of: soooossssssssssooss, wherein each "s" represents a phosphorothioate internucleoside linkage and each "o" represents a phosphodiester internucleoside linkage.

All cytosine residues are 5-methylcytosines.

"Start site" indicates the 5'-most nucleoside to which the modified oligonucleotide is complementary in target nucleic acid sequence. "Stop site" indicates the 3'-most nucleoside to which the modified oligonucleotide is complementary in the target nucleic acid sequence. Each modified oligonucleotide listed in the Tables below is 100% complementary to SEQ ID NO: 1. Start and stop sites for Compound 750519 are marked with a hashtag (#) in several tables below. The complete list of start sites for Compound 750519 are listed in Table 4b.

Human IPS cell derived ReproNeuro™ Neurons (Repro-CELL) were cultured per manufacturer instructions at 40,000 cells per well and were treated with 8,000 nM of modified oligonucleotide by free uptake. After a treatment period of approximately 5 days, total RNA was isolated from the cells and UBE3A-ATS RNA levels were measured by quantitative real-time RTPCR. Human UBE3A-ATS primer probe set RTS4796 (described herein in Example 1) was used to measure RNA levels. UBE3A-ATS RNA levels were normalized to total RNA content, as measured by RIBOGREENO. Reduction of UBE3A-ATS is presented in the tables below as percent UBE3A-ATS RNA amount relative to untreated control (UTC) cells. Each table represents results from an individual assay plate. The values marked with an asterisk (*) indicate that the modified oligonucleotide is complementary to the amplicon region of the primer probe set. Additional assays may be used to measure the potency and efficacy of the modified oligonucleotides complementary to the amplicon region.

TABLE 34

Reduction of UBE3A-ATS RNA by 8,000 nM 5-10-5 MOE gapmers with mixed PO/PS internucleoside linkages in vitro

| Compound Number | SEQ ID NO: 1 Start Site | SEQ ID NO: 1 Stop Site | Sequence (5' to 3') | UBE3A-ATS (% UTC) | SEQ ID NO |
|---|---|---|---|---|---|
| 617557 | 483977 | 483996 | ATCATGTGCATACCCAGGGT | 38 | 172 |
| 749882 | 460115 | 460134 | ACTTTATAGTGTGGATGGTA | 30 | 586 |
| 750519 | 349103# | 349122# | GTCATCACCTCTCTTCAGGA | 23 | 181 |
| 1165438 | 448412 | 448431 | AAGGGTCTTAGTGCCAAATA | 75 | 2075 |
| 1165443 | 449094 | 449113 | ATGCTAGTCACTCATTGAGA | 65 | 2076 |
| 1165448 | 449641 | 449660 | TGATCCATTAGATAGGCTAT | 80 | 2077 |
| 1165450 | 452254 | 452273 | TCTCACGCTGTGTGAATCAA | 81 | 2078 |
| 1165456 | 452267 | 452286 | AGGGAAGTCTAGGTCTCACG | 54 | 2079 |
| 1165472 | 454155 | 454174 | GACCCTTATGGAGACTTATA | 77 | 2080 |
| 1165478 | 454464 | 454483 | GTGGACTCCACACACCTACT | 62 | 2081 |
| 1165484 | 454579 | 454598 | GCAAGCAAAGACTACACCGT | 48 | 2082 |
| 1165488 | 454856 | 454875 | ATATTCCCTATCCAGGGTAG | 91 | 2083 |
| 1165494 | 454862 | 454881 | AGGTGTATATTCCCTATCCA | 76 | 2084 |
| 1165500 | 455029 | 455048 | TGATATTGCAGTGGGATGGC | 59 | 2085 |
| 1165504 | 456625 | 456644 | GCATGGTTATCTAATGCATC | 60 | 2086 |
| 1165511 | 220440 456809 | 220459 456828 | GAGGGATCCCCAAATAGAGC | 51 | 2087 |
| 1165517 | 457019 | 457038 | ATCACAGTTGCTTGACCCTT | 63 | 2088 |
| 1165523 | 457983 | 458002 | TGATCTATTATGAGGGCATC | 25 | 2089 |

TABLE 34-continued

Reduction of UBE3A-ATS RNA by 8,000 nM 5-10-5 MOE gapmers with mixed PO/PS internucleoside linkages in vitro

| Compound Number | SEQ ID NO: 1 Start Site | SEQ ID NO: 1 Stop Site | Sequence (5' to 3') | UBE3A-ATS (% UTC) | SEQ ID NO |
|---|---|---|---|---|---|
| 1165529 | 458792 | 458811 | TTCCCTAATATAGGGCAGAT | 49 | 2090 |
| 1165535 | 458943 | 458962 | CTATAGGACCTCAGGAGATT | 42 | 2091 |
| 1165540 | 458951 | 458970 | CTCAAGACCTATAGGACCTC | 50 | 2092 |
| 1165547 | 460109 | 460128 | TAGTGTGGATGGTATCCTGG | 55 | 2093 |
| 1165552 | 460506 | 460525 | TAGGGTGGTTGGTTCAAAAT | 24 | 2094 |
| 1165558 | 460842 | 460861 | CACACATATAGGCTAGCCAA | 44 | 2095 |
| 1165562 | 461414 | 461433 | TGGGTTACTTTCCAATAGAG | 27 | 2096 |
| 1165573 | 464387 | 464406 | CTTAGGTAGTTCACAACTCT | 37 | 2097 |
| 1165578 | 464556 | 464575 | CCTGTAGTATGTGGATACTG | 40 | 2098 |
| 1165588 | 465372 | 465391 | GGATGGTGTGTATGTTATGA | 32 | 2099 |
| 1165599 | 467293 | 467312 | GTAGTCTATTGGTGTTCCTT | 45 | 2100 |
| 1165604 | 467418 | 467437 | ATACGCTCCTTCATTTCATG | 49 | 2101 |
| 1165613 | 483363 | 483382 | GAATTCAATGGACCCACATG | 67 | 2102 |
| 1165619 | 483961 | 483980 | GGGTAGGATTCATGGTCCAA | 43 | 2103 |
| 1165626 | 486352 | 486371 | TAATAGACTGCGATTATACA | 64 | 2104 |
| 1165642 | 493857 | 493876 | GGCCTAATCTATGCTGGGCC | 63 | 2105 |
| 1165648 | 493865 | 493884 | TGAGATTAGGCCTAATCTAT | 79 | 2106 |
| 1165654 | 496831 | 496850 | GATTAGGTATGGAGGCCATG | 48 | 2107 |
| 1165659 | 499667 | 499686 | CCCCAATACAGATTCAGTGG | 75 | 2108 |
| 1165665 | 499676 | 499695 | TCAAGGTAGCCCCAATACAG | 44 | 2109 |
| 1165669 | 500693 | 500712 | CAAGAGGTACTGTAAGCCCT | 87 | 2110 |
| 1165674 | 500907 | 500926 | TGTTTTGACCTAACTGGCCT | 75 | 2111 |
| 1165679 | 501761 | 501780 | GCTAAGAGTCACCTGTATCC | 53 | 2112 |
| 1165685 | 502372 | 502391 | AAGGTATTAAGGCCCTTGGC | 54 | 2113 |
| 1165702 | 503347 | 503366 | GGTGATCAGCTCAACACCCC | 73 | 2114 |
| 1165708 | 503362 | 503381 | AGGAGTGTTAGCCCAGGTGA | 53 | 2115 |
| 1165714 | 503369 | 503388 | GGGTCATAGGAGTGTTAGCC | 77 | 2116 |
| 1165720 | 503423 | 503442 | AAGGTGATGACACCCCTACC | 67 | 2117 |
| 1165730 | 504128 | 504147 | AGCTATTTCATTAAGTCACC | 43 | 2118 |
| 1165737 | 504432 | 504451 | GTATATTAGTCTAAGGCAGT | 30 | 2119 |
| 1165742 | 504976 | 504995 | TATTATCTTCTTAGGGTCGA | 37 | 2120 |
| 1165748 | 505174 | 505193 | TGTGTACCGAGCTCAAGAAC | 55 | 2121 |
| 1165754 | 505184 | 505203 | AGTCTGTCTCTGTGTACCGA | 70 | 2122 |
| 1165759 | 505217 | 505236 | GACACTCTCGCTGAGGACAC | 58 | 2123 |
| 1165767 | 505321 | 505340 | GCCGCCTCTGTTATTGTGAT | 56 | 2124 |
| 1165773 | 505328 | 505347 | AAATTGGGCCGCCTCTGTTA | 41 | 2125 |

TABLE 34-continued

Reduction of UBE3A-ATS RNA by 8,000 nM 5-10-5 MOE gapmers with mixed PO/PS internucleoside linkages in vitro

| Compound Number | SEQ ID NO: 1 Start Site | SEQ ID NO: 1 Stop Site | Sequence (5' to 3') | UBE3A-ATS (% UTC) | SEQ ID NO |
|---|---|---|---|---|---|
| 1165784 | 505746 | 505765 | CTGTAGGTTGACAGGACATG | 50 | 2126 |
| 1165790 | 505822 | 505841 | TGAGGGTGCTTAGTGAACTG | 78 | 2127 |
| 1165801 | 506449 | 506468 | GAGTCTGTCTTTAGGGTCAC | 42 | 2128 |
| 1165803 | 507899 | 507918 | CGATACCTGCTTTTGTGACA | 54 | 2129 |
| 1165807 | 507908 | 507927 | ATAGCCATTCGATACCTGCT | 56 | 2130 |
| 1165813 | 507916 | 507935 | ACTGCAGGATAGCCATTCGA | 72 | 2131 |
| 1165824 | 508792 | 508811 | TATGAATGCCACCGTGATTG | 79 | 2132 |
| 1165846 | 453364 | 453383 | AACTACATAGGCACTCTACT | 78 | 2133 |
| 1165859 | 461526 | 461545 | AACATTCAGCTAGACTAGTT | 43 | 2134 |
| 1165860 | 461902 | 461921 | ATGAGACCCCACAATTTGGT | 79 | 2135 |
| 1165866 | 464995 | 465014 | ATAGAGGCCCTCTTGTTTCA | 60 | 2136 |
| 1165868 | 465391 | 465410 | CAATTGTCAGACTTATTGAG | 66 | 2137 |
| 1165872 | 465893 | 465912 | GAACTCCCACAAGGTACTCT | 45 | 2138 |
| 1165875 | 468353 | 468372 | CTGTAGTATGCATTGACAAG | 53 | 2139 |
| 1165881 | 484299 | 484318 | TACTAGGGCCAGAGAATCCA | 55 | 2140 |
| 1165885 | 488335 | 488354 | AAGCCACTCATGTACATGAG | 55 | 2141 |
| 1165887 | 489494 | 489513 | AAACTGGGTTGAGACTATTC | 42 | 2142 |
| 1165888 | 489580 | 489599 | CTGCAGTGGTACCACAGACC | 40 | 2143 |
| 1165896 | 502392 | 502411 | TGACTACACATCTTGTATAC | 73 | 2144 |
| 1165897 | 502450 | 502469 | CTAGGCAGCTCTTTGTAGGC | 25 | 2145 |
| 1165898 | 503807 | 503826 | CCCTATAGGTCAAAAATGCC | 51 | 2146 |
| 1165903 | 505544 | 505563 | TCAGTCAGGTACAGGTGTTG | 58 | 2147 |
| 1165904 | 505834 | 505853 | GTCAAAGACCTGTGAGGGTG | 63 | 2148 |
| 1165913 | 510480 | 510499 | GGTCTTTGCAGTTAAGTTAT | 65 | 2149 |

TABLE 35

Reduction of UBE3A-ATS RNA by 8,000 nM 5-10-5 MOE gapmers with mixed PO/PS internucleoside linkages in vitro

| Compound Number | SEQ ID NO: 1 Start Site | SEQ ID NO: 1 Stop Site | Sequence (5' to 3') | UBE3A-ATS (% UTC) | SEQ ID NO |
|---|---|---|---|---|---|
| 617557 | 483977 | 483996 | ATCATGTGCATACCCAGGGT | 52 | 172 |
| 749882 | 460115 | 460134 | ACTTTATAGTGTGGATGGTA | 38 | 586 |
| 750519 | 349103# | 349122# | GTCATCACCTCTCTTCAGGA | 26 | 181 |
| 1165437 | 448410 | 448429 | GGGTCTTAGTGCCAAATATC | 112 | 2150 |
| 1165454 | 452264 | 452283 | GAAGTCTAGGTCTCACGCTG | 84 | 2151 |
| 1165466 | 453361 | 453380 | TACATAGGCACTCTACTAGC | 96 | 2152 |

TABLE 35-continued

Reduction of UBE3A-ATS RNA by 8,000 nM 5-10-5 MOE gapmers with mixed PO/PS internucleoside linkages in vitro

| Compound Number | SEQ ID NO: 1 Start Site | SEQ ID NO: 1 Stop Site | Sequence (5' to 3') | UBE3A-ATS (% UTC) | SEQ ID NO |
|---|---|---|---|---|---|
| 1165470 | 454153 | 454172 | CCCTTATGGAGACTTATATA | 81 | 2153 |
| 1165476 | 454164 | 454183 | TGAAGATTTGACCCTTATGG | 114 | 2154 |
| 1165482 | 454577 | 454596 | AAGCAAAGACTACACCGTGA | 80 | 2155 |
| 1165486 | 454847 | 454866 | ATCCAGGGTAGAAGACTAGC | 75 | 2156 |
| 1165492 | 454860 | 454879 | GTGTATATTCCCTATCCAGG | 83 | 2157 |
| 1165498 | 455016 | 455035 | GGATGGCTGTCAATGCTGAT | 84 | 2158 |
| 1165502 | 455214 | 455233 | ACAAGTCTACTACCAATAAG | 57 | 2159 |
| 1165508 | 220325 456694 | 220344 456713 | ATTCTCATCATCGATCCAAA | 58 | 2160 |
| 1165515 | 457017 | 457036 | CACAGTTGCTTGACCCTTAA | 58 | 2161 |
| 1165521 | 457382 | 457401 | GATTCAATAGTGTAGGTGAC | 29 | 2162 |
| 1165527 | 458789 | 458808 | CCTAATATAGGGCAGATGAT | 53 | 2163 |
| 1165533 | 458939 | 458958 | AGGACCTCAGGAGATTGTAC | 29 | 2164 |
| 1165538 | 458949 | 458968 | CAAGACCTATAGGACCTCAG | 29 | 2165 |
| 1165545 | 459548 | 459567 | AGACTATCCTGGTATGACTG | 22 | 2166 |
| 1165551 | 460353 | 460372 | TGATTGACTACTTCAACCTG | 64 | 2167 |
| 1165556 | 460512 | 460531 | CGTTTATAGGGTGGTTGGTT | 38 | 2168 |
| 1165564 | 461520 | 461539 | CAGCTAGACTAGTTGAAATC | 51 | 2169 |
| 1165569 | 461900 | 461919 | GAGACCCCACAATTTGGTCC | 94 | 2170 |
| 1165571 | 463886 | 463905 | AGGCAGTTGTGATAGTCAAC | 93 | 2171 |
| 1165577 | 464397 | 464416 | CCATTCAGCACTTAGGTAGT | 29 | 2172 |
| 1165581 | 464561 | 464580 | TATGCCCTGTAGTATGTGGA | 56 | 2173 |
| 1165586 | 465244 | 465263 | TTTTATTGGTCATCTCGGGT | 27 | 2174 |
| 1165591 | 465385 | 465404 | TCAGACTTATTGAGGATGGT | 47 | 2175 |
| 1165597 | 466248 | 466267 | ACTGGTAGGATCTATGGCAG | 43 | 2176 |
| 1165602 | 467299 | 467318 | CACAGAGTAGTCTATTGGTG | 62 | 2177 |
| 1165608 | 467805 | 467824 | GTCTCCCTCTTAGTGATTGG | 25 | 2178 |
| 1165611 | 474168 | 474187 | AGTGGTTGCCTTAGTATTAC | 20 | 2179 |
| 1165617 | 483858 | 483877 | TGTAAATGGCCTGACTAGGC | 75 | 2180 |
| 1165624 | 485655 | 485674 | CTAGGACCAGTTGGTTCACT | 72 | 2181 |
| 1165637 | 489520 | 489539 | AATGGACCACCTAAGACCTC | 85 | 2182 |
| 1165640 | 493853 | 493872 | TAATCTATGCTGGGCCCAA | 76 | 2183 |
| 1165646 | 493863 | 493882 | AGATTAGGCCTAATCTATGC | 94 | 2184 |
| 1165652 | 496808 | 496827 | GACCCTCATCACTTTTTGAC | 66 | 2185 |
| 1165658 | 498508 | 498527 | GCCCGGCAAGAGATTCACTT | 79 | 2186 |
| 1165663 | 499673 | 499692 | AGGTAGCCCCAATACAGATT | 60 | 2187 |

TABLE 35-continued

Reduction of UBE3A-ATS RNA by 8,000 nM 5-10-5 MOE gapmers with mixed PO/PS internucleoside linkages in vitro

| Compound Number | SEQ ID NO: 1 Start Site | SEQ ID NO: 1 Stop Site | Sequence (5' to 3') | UBE3A-ATS (% UTC) | SEQ ID NO |
|---|---|---|---|---|---|
| 1165667 | 500493 | 500512 | AGGGCCATGTTAAAGGCCTC | 82 | 2188 |
| 1165672 | 500901 | 500920 | GACCTAACTGGCCTTTGGGT | 64 | 2189 |
| 1165683 | 502143 | 502162 | TATGTGGAATCAGTGCTACC | 75 | 2190 |
| 1165689 | 502377 | 502396 | TATACAAGGTATTAAGGCCC | 55 | 2191 |
| 1165694 | 502446 | 502465 | GCAGCTCTTTGTAGGCCCAA | 25 | 2192 |
| 1165700 | 503099 | 503118 | GACTAATAGGCCTTTCTACA | 59 | 2193 |
| 1165706 | 503360 | 503379 | GAGTGTTAGCCCAGGTGATC | 57 | 2194 |
| 1165712 | 503366 | 503385 | TCATAGGAGTGTTAGCCCAG | 36 | 2195 |
| 1165718 | 503420 | 503439 | GTGATGACACCCCTACCATG | 96 | 2196 |
| 1165724 | 503427 | 503446 | GATTAAGGTGATGACACCCC | 27 | 2197 |
| 1165728 | 503943 | 503962 | CACCAACCTTAAATAGTAGG | 63 | 2198 |
| 1165735 | 504429 | 504448 | TATTAGTCTAAGGCAGTCAG | 78 | 2199 |
| 1165741 | 504653 | 504672 | GGAGCCTTACGCTTGGCTGA | 55 | 2200 |
| 1165746 | 505172 | 505191 | TGTACCGAGCTCAAGAACTG | 58 | 2201 |
| 1165752 | 505180 | 505199 | TGTCTCTGTGTACCGAGCTC | 59 | 2202 |
| 1165758 | 505215 | 505234 | CACTCTCGCTGAGGACACAT | 60 | 2203 |
| 1165765 | 505319 | 505338 | CGCCTCTGTTATTGTGATAT | 83 | 2204 |
| 1165771 | 505326 | 505345 | ATTGGGCCGCCTCTGTTATT | 54 | 2205 |
| 1165777 | 505333 | 505352 | TGTAGAAATTGGGCCGCCTC | 41 | 2206 |
| 1165782 | 505744 | 505763 | GTAGGTTGACAGGACATGCT | 75 | 2207 |
| 1165788 | 505819 | 505838 | GGGTGCTTAGTGAACTGTGG | 30 | 2208 |
| 1165794 | 505829 | 505848 | AGACCTGTGAGGGTGCTTAG | 84 | 2209 |
| 1165799 | 506279 | 506298 | GTCTACCAGGGTGGTATTAT | 70 | 2210 |
| 1165802 | 506782 | 506801 | TATATACTCCAGGTTGTGGA | 44 | 2211 |
| 1165805 | 507906 | 507925 | AGCCATTCGATACCTGCTTT | 50 | 2212 |
| 1165811 | 507913 | 507932 | GCAGGATAGCCATTCGATAC | 78 | 2213 |
| 1165822 | 508789 | 508808 | GAATGCCACCGTGATTGCAA | 51 | 2214 |
| 1165827 | 510129 | 510148 | GCACATAGACCATAGCTGAA | 32 | 2215 |
| 1165840 | 448466 | 448485 | CAATAGAATAGTGCCAGTAG | 74 | 2216 |
| 1165841 | 449441 | 449460 | TGATCATACTGGAGCCAGGT | 60 | 2217 |
| 1165845 | 452251 | 452270 | CACGCTGTGTGAATCAAAAG | 87 | 2218 |
| 1165855 | 460974 | 460993 | GTGTTTATCCAAACCAAGGG | 21 | 2219 |
| 1165871 | 465890 | 465909 | CTCCCACAAGGTACTCTTGC | 72 | 2220 |
| 1165879 | 484093 | 484112 | GGATGTCAGTTCAGATGAAC | 74 | 2221 |
| 1165883 | 486393 | 486412 | CAACATAGATCCTCTGTTAG | 74 | 2222 |

TABLE 35-continued

Reduction of UBE3A-ATS RNA by 8,000 nM 5-10-5 MOE gapmers with mixed PO/PS internucleoside linkages in vitro

| Compound Number | SEQ ID NO: 1 Start Site | SEQ ID NO: 1 Stop Site | Sequence (5' to 3') | UBE3A-ATS (% UTC) | SEQ ID NO |
|---|---|---|---|---|---|
| 1165886 | 489101 | 489120 | CTGCTCCCTAAGCTTAGATA | 58 | 2223 |
| 1165895 | 501152 | 501171 | AGTAAAGAGCCACCTAAGGG | 100 | 2224 |

TABLE 36

Reduction of UBE3A-ATS RNA by 8,000 nM 5-10-5 MOE gapmers with mixed PO/PS internucleoside linkages in vitro

| Compound Number | SEQ ID NO: 1 Start Site | SEQ ID NO: 1 Stop Site | Sequence (5' to 3') | UBE3A-ATS (% UTC) | SEQ ID NO |
|---|---|---|---|---|---|
| 617557 | 483977 | 483996 | ATCATGTGCATACCCAGGGT | 40 | 172 |
| 749882 | 460115 | 460134 | ACTTTATAGTGTGGATGGTA | 75 | 586 |
| 750519 | 349103# | 349122# | GTCATCACCTCTCTTCAGGA | 28 | 181 |
| 1165436 | 448409 | 448428 | GGTCTTAGTGCCAAATATCC | 46 | 2225 |
| 1165441 | 448460 | 448479 | AATAGTGCCAGTAGGACTTA | 71 | 2226 |
| 1165446 | 449099 | 449118 | CAAGTATGCTAGTCACTCAT | 40 | 2227 |
| 1165453 | 452260 | 452279 | TCTAGGTCTCACGCTGTGTG | 53 | 2228 |
| 1165460 | 453213 | 453232 | ATAGTGTTCTTACATCCACC | 59 | 2229 |
| 1165469 | 454152 | 454171 | CCTTATGGAGACTTATATAC | 103 | 2230 |
| 1165475 | 454163 | 454182 | GAAGATTTGACCCTTATGGA | 91 | 2231 |
| 1165481 | 454576 | 454595 | AGCAAAGACTACACCGTGAC | 69 | 2232 |
| 1165491 | 454859 | 454878 | TGTATATTCCCTATCCAGGG | 106 | 2233 |
| 1165497 | 455015 | 455034 | GATGGCTGTCAATGCTGATA | 53 | 2234 |
| 1165507 | 220321 456690 | 220340 456709 | TCATCATCGATCCAAACAAG | 58 | 2235 |
| 1165514 | 457016 | 457035 | ACAGTTGCTTGACCCTTAAT | 126 | 2236 |
| 1165520 | 457379 | 457398 | TCAATAGTGTAGGTGACATG | 63 | 2237 |
| 1165526 | 458398 | 458417 | ATGTGGGCCTCTATTAAGAT | 47 | 2238 |
| 1165532 | 458937 | 458956 | GACCTCAGGAGATTGTACAA | 45 | 2239 |
| 1165537 | 458948 | 458967 | AAGACCTATAGGACCTCAGG | 53 | 2240 |
| 1165544 | 459547 | 459566 | GACTATCCTGGTATGACTGT | 57 | 2241 |
| 1165550 | 460352 | 460371 | GATTGACTACTTCAACCTGA | 23 | 2242 |
| 1165555 | 460510 | 460529 | TTTATAGGGTGGTTGGTTCA | 30 | 2243 |
| 1165561 | 460850 | 460869 | GGATTTACCACACATATAGG | 39 | 2244 |
| 1165563 | 461451 | 461470 | GGTAAGGCAGCTCCTGACAA | 32 | 2245 |
| 1165568 | 461899 | 461918 | AGACCCCACAATTTGGTCCC | 51 | 2246 |
| 1165576 | 464390 | 464409 | GCACTTAGGTAGTTCACAAC | 41 | 2247 |
| 1165585 | 465243 | 465262 | TTTATTGGTCATCTCGGGTA | 44 | 2248 |

TABLE 36-continued

Reduction of UBE3A-ATS RNA by 8,000 nM 5-10-5 MOE gapmers with mixed PO/PS internucleoside linkages in vitro

| Compound Number | SEQ ID NO: 1 Start Site | SEQ ID NO: 1 Stop Site | Sequence (5' to 3') | UBE3A-ATS (% UTC) | SEQ ID NO |
|---|---|---|---|---|---|
| 1165590 | 465384 | 465403 | CAGACTTATTGAGGATGGTG | 30 | 2249 |
| 1165593 | 465564 | 465583 | TTAGGACAAGTCTTATAGAG | 20 | 2250 |
| 1165596 | 466247 | 466266 | CTGGTAGGATCTATGGCAGT | 32 | 2251 |
| 1165601 | 467298 | 467317 | ACAGAGTAGTCTATTGGTGT | 67 | 2252 |
| 1165607 | 467804 | 467823 | TCTCCCTCTTAGTGATTGGT | 45 | 2253 |
| 1165616 | 483851 | 483870 | GGCCTGACTAGGCATTGAAT | 16 | 2254 |
| 1165621 | 483976 | 483995 | TCATGTGCATACCCAGGGTA | 76 | 2255 |
| 1165623 | 485654 | 485673 | TAGGACCAGTTGGTTCACTG | 66 | 2256 |
| 1165629 | 486356 | 486375 | ATGTTAATAGACTGCGATTA | 102 | 2257 |
| 1165632 | 489099 | 489118 | GCTCCCTAAGCTTAGATATA | 85 | 2258 |
| 1165636 | 489519 | 489538 | ATGGACCACCTAAGACCTCA | 79 | 2259 |
| 1165639 | 493852 | 493871 | AATCTATGCTGGGCCCCAAT | 52 | 2260 |
| 1165645 | 493862 | 493881 | GATTAGGCCTAATCTATGCT | 71 | 2261 |
| 1165651 | 496565 | 496584 | TCCATCTACTATTAATGAGC | 81 | 2262 |
| 1165657 | 497266 | 497285 | GATTAGGCAGCTTCACTACT | 52 | 2263 |
| 1165662 | 499671 | 499690 | GTAGCCCCAATACAGATTCA | 35 | 2264 |
| 1165671 | 500900 | 500919 | ACCTAACTGGCCTTTGGGTC | 111 | 2265 |
| 1165677 | 500913 | 500932 | TCAAGGTGTTTTGACCTAAC | 64 | 2266 |
| 1165682 | 501766 | 501785 | GATGGGCTAAGAGTCACCTG | 99 | 2267 |
| 1165688 | 502375 | 502394 | TACAAGGTATTAAGGCCCTT | 98 | 2268 |
| 1165693 | 502442 | 502461 | CTCTTTGTAGGCCCAAGGGA | 66 | 2269 |
| 1165698 | 502763 | 502782 | AATAGGCACTTCGGGCAAAT | 75 | 2270 |
| 1165705 | 503359 | 503378 | AGTGTTAGCCCAGGTGATCA | 71 | 2271 |
| 1165711 | 503365 | 503384 | CATAGGAGTGTTAGCCCAGG | 61 | 2272 |
| 1165717 | 503419 | 503438 | TGATGACACCCCTACCATGG | 96 | 2273 |
| 1165723 | 503426 | 503445 | ATTAAGGTGATGACACCCCT | 81 | 2274 |
| 1165734 | 504428 | 504447 | ATTAGTCTAAGGCAGTCAGG | 96 | 2275 |
| 1165740 | 504436 | 504455 | GTAGGTATATTAGTCTAAGG | 51 | 2276 |
| 1165745 | 505171 | 505190 | GTACCGAGCTCAAGAACTGT | 71 | 2277 |
| 1165751 | 505178 | 505197 | TCTCTGTGTACCGAGCTCAA | 58 | 2278 |
| 1165757 | 505214 | 505233 | ACTCTCGCTGAGGACACATC | 73 | 2279 |
| 1165762 | 505223 | 505242 | AATGAGGACACTCTCGCTGA | 76 | 2280 |
| 1165770 | 505325 | 505344 | TTGGGCCGCCTCTGTTATTG | 51 | 2281 |
| 1165776 | 505332 | 505351 | GTAGAAATTGGGCCGCCTCT | 35 | 2282 |
| 1165781 | 505743 | 505762 | TAGGTTGACAGGACATGCTG | 66 | 2283 |
| 1165787 | 505815 | 505834 | GCTTAGTGAACTGTGGGCAC | 72 | 2284 |
| 1165793 | 505827 | 505846 | ACCTGTGAGGGTGCTTAGTG | 62 | 2285 |

TABLE 36-continued

Reduction of UBE3A-ATS RNA by 8,000 nM 5-10-5 MOE gapmers with mixed PO/PS internucleoside linkages in vitro

| Compound Number | SEQ ID NO: 1 Start Site | SEQ ID NO: 1 Stop Site | Sequence (5' to 3') | UBE3A-ATS (% UTC) | SEQ ID NO |
|---|---|---|---|---|---|
| 1165798 | 506277 | 506296 | CTACCAGGGTGGTATTATAA | 33 | 2286 |
| 1165810 | 507912 | 507931 | CAGGATAGCCATTCGATACC | 44 | 2287 |
| 1165821 | 508786 | 508805 | TGCCACCGTGATTGCAAAGT | 61 | 2288 |
| 1165826 | 510127 | 510146 | ACATAGACCATAGCTGAACC | 65 | 2289 |
| 1165844 | 449863 | 449882 | GGCATCCTTAAATCCTGGTT | 66 | 2290 |
| 1165849 | 454845 | 454864 | CCAGGGTAGAAGACTAGCAT | 74 | 2291 |
| 1165851 | 455058 | 455077 | GAACCCTTTGGTCTAAGCAA | 80 | 2292 |
| 1165863 | 463777 | 463796 | TATAGATTGGGCTTTAGAGG | 76 | 2293 |
| 1165865 | 464560 | 464579 | ATGCCCTGTAGTATGTGGAT | 74 | 2294 |
| 1165877 | 473792 | 473811 | GTAATGCTGTTGTACACTAG | 59 | 2295 |
| 1165893 | 499914 | 499933 | TTTTGCATAATAGGAGGTCC | 62 | 2296 |
| 1165899 | 503942 | 503961 | ACCAACCTTAAATAGTAGGA | 61 | 2297 |
| 1165907 | 506780 | 506799 | TATACTCCAGGTTGTGGAGG | 55 | 2298 |
| 1165910 | 507903 | 507922 | CATTCGATACCTGCTTTTGT | 71 | 2299 |

TABLE 37

Reduction of UBE3A-ATS RNA by 8,000 nM 5-10-5 MOE gapmers with mixed PO/PS internucleoside linkages in vitro

| Compound Number | SEQ ID NO: 1 Start Site | SEQ ID NO: 1 Stop Site | Sequence (5' to 3') | UBE3A-ATS (% UTC) | SEQ ID NO |
|---|---|---|---|---|---|
| 1065438 | 449442 | 449461 | ATGATCATACTGGAGCCAGG | 65 | 1936 |
| 1178376 | 220314 456683 | 220333 456702 | CGATCCAAACAAGCACCCTC | 80 | 2300 |
| 1178378 | 220316 456685 | 220335 456704 | ATCGATCCAAACAAGCACCC | 69 | 2301 |
| 1178380 | 220319 456688 | 220338 456707 | ATCATCGATCCAAACAAGCA | 55 | 2302 |
| 1178385 | 456754 | 456773 | CCGCACATCTGGACCTCAGA | 97 | 2303 |
| 1178387 | 456756 | 456775 | GGCCGCACATCTGGACCTCA | 89 | 2304 |
| 1178389 | 456759 | 456778 | GAGGGCCGCACATCTGGACC | 94 | 2305 |
| 1178391 | 456761 | 456780 | TGGAGGGCCGCACATCTGGA | 83 | 2306 |
| 1178393 | 456763 | 456782 | ATTGGAGGGCCGCACATCTG | 93 | 2307 |
| 1178395 | 456765 | 456784 | CTATTGGAGGGCCGCACATC | 63 | 2308 |
| 1178397 | 456767 | 456786 | TCCTATTGGAGGGCCGCACA | 90 | 2309 |
| 1178399 | 456770 | 456789 | TTGTCCTATTGGAGGGCCGC | 64 | 2310 |
| 1178401 | 220403 456772 | 220422 456791 | ATTTGTCCTATTGGAGGGCC | 101 | 2311 |
| 1178403 | 220452 456821 | 220471 456840 | TATGTTGTCACTGAGGGATC | 78 | 2312 |

TABLE 37-continued

Reduction of UBE3A-ATS RNA by 8,000 nM 5-10-5 MOE gapmers with mixed PO/PS internucleoside linkages in vitro

| Compound Number | SEQ ID NO: 1 Start Site | SEQ ID NO: 1 Stop Site | Sequence (5' to 3') | UBE3A-ATS (% UTC) | SEQ ID NO |
|---|---|---|---|---|---|
| 1178405 | 220456 456825 | 220475 456844 | GTACTATGTTGTCACTGAGG | 80 | 2313 |
| 1178407 | 456863 | 456882 | GCCCTCTTCGAAGAGATAGA | 90 | 2314 |
| 1178409 | 456865 | 456884 | CTGCCCTCTTCGAAGAGATA | 58 | 2315 |
| 1178410 | 456913 | 456932 | GTCACTAGGCACACTAAAGT | 62 | 2316 |
| 1178412 | 456915 | 456934 | GGGTCACTAGGCACACTAAA | 76 | 2317 |
| 1178414 | 456922 | 456941 | AAGTCTTGGGTCACTAGGCA | 63 | 2318 |
| 1178416 | 456924 | 456943 | GCAAGTCTTGGGTCACTAGG | 81 | 2319 |
| 1178419 | 457236 | 457255 | ATGGCTTAGCTACTCACCCC | 68 | 2320 |
| 1178421 | 457239 | 457258 | ATAATGGCTTAGCTACTCAC | 60 | 2321 |
| 1178424 | 457287 | 457306 | ACGACCTAAAGACCTAGCAA | 49 | 2322 |
| 1178427 | 457297 | 457316 | GATGTACAAAACGACCTAAA | 60 | 2323 |
| 1179741 | 448298 | 448317 | ACAAGTTTCGCAATAAGATT | 55 | 2324 |
| 1179743 | 448414 | 448433 | GCAAGGGTCTTAGTGCCAAA | 78 | 2325 |
| 1179744 | 448450 | 448469 | GTAGGACTTACTAAATCATC | 75 | 2326 |
| 1179746 | 448454 | 448473 | GCCAGTAGGACTTACTAAAT | 57 | 2327 |
| 1179748 | 448456 | 448475 | GTGCCAGTAGGACTTACTAA | 62 | 2328 |
| 1179750 | 448629 | 448648 | AGGATTGCATCACATGTGTC | 56 | 2329 |
| 1179752 | 448714 | 448733 | AGCGCATTGAGCAAAATTCC | 82 | 2330 |
| 1179754 | 448716 | 448735 | GTAGCGCATTGAGCAAAATT | 76 | 2331 |
| 1179756 | 448718 | 448737 | CTGTAGCGCATTGAGCAAAA | 83 | 2332 |
| 1179758 | 448720 | 448739 | AACTGTAGCGCATTGAGCAA | 52 | 2333 |
| 1179760 | 448723 | 448742 | GATAACTGTAGCGCATTGAG | 85 | 2334 |
| 1179762 | 448726 | 448745 | CACGATAACTGTAGCGCATT | 38 | 2335 |
| 1179764 | 448728 | 448747 | ACCACGATAACTGTAGCGCA | 67 | 2336 |
| 1179766 | 448731 | 448750 | TAGACCACGATAACTGTAGC | 80 | 2337 |
| 1179768 | 448733 | 448752 | TTTAGACCACGATAACTGTA | 54 | 2338 |
| 1179771 | 448738 | 448757 | GTATATTTAGACCACGATAA | 58 | 2339 |
| 1179773 | 448741 | 448760 | TCTGTATATTTAGACCACGA | 49 | 2340 |
| 1179775 | 448831 | 448850 | GCAAGGACCCTTAAGTCATA | 72 | 2341 |
| 1179777 | 448836 | 448855 | CAATTGCAAGGACCCTTAAG | 99 | 2342 |
| 1179779 | 448842 | 448861 | TTATCCCAATTGCAAGGACC | 49 | 2343 |
| 1179780 | 448920 | 448939 | AGTCAGGCACCAGATTGCTC | 112 | 2344 |
| 1179782 | 448949 | 448968 | AACGAAGCCAAAGGTACTTG | 80 | 2345 |
| 1179784 | 449036 | 449055 | CGGCCCTGACTGTCATTCAT | 71 | 2346 |
| 1179786 | 449038 | 449057 | AACGGCCCTGACTGTCATTC | 53 | 2347 |
| 1179788 | 449040 | 449059 | GGAACGGCCCTGACTGTCAT | 95 | 2348 |

TABLE 37-continued

Reduction of UBE3A-ATS RNA by 8,000 nM 5-10-5 MOE gapmers with mixed PO/PS internucleoside linkages in vitro

| Compound Number | SEQ ID NO: 1 Start Site | SEQ ID NO: 1 Stop Site | Sequence (5' to 3') | UBE3A-ATS (% UTC) | SEQ ID NO |
|---|---|---|---|---|---|
| 1179790 | 449043 | 449062 | GAAGGAACGGCCCTGACTGT | 70 | 2349 |
| 1179792 | 449045 | 449064 | CTGAAGGAACGGCCCTGACT | 105 | 2350 |
| 1179794 | 449047 | 449066 | GCCTGAAGGAACGGCCCTGA | 111 | 2351 |
| 1179796 | 449051 | 449070 | TGTGGCCTGAAGGAACGGCC | 100 | 2352 |
| 1179798 | 449054 | 449073 | TCATGTGGCCTGAAGGAACG | 68 | 2353 |
| 1179800 | 449059 | 449078 | GATAATCATGTGGCCTGAAG | 49 | 2354 |
| 1179802 | 449062 | 449081 | AACGATAATCATGTGGCCTG | 86 | 2355 |
| 1179804 | 449064 | 449083 | ATAACGATAATCATGTGGCC | 52 | 2356 |
| 1179806 | 449096 | 449115 | GTATGCTAGTCACTCATTGA | 91 | 2357 |
| 1179808 | 449102 | 449121 | TGGCAAGTATGCTAGTCACT | 12 | 2358 |
| 1179810 | 449104 | 449123 | CCTGGCAAGTATGCTAGTCA | 76 | 2359 |
| 1179812 | 449107 | 449126 | GATCCTGGCAAGTATGCTAG | 103 | 2360 |
| 1179814 | 449109 | 449128 | TAGATCCTGGCAAGTATGCT | 71 | 2361 |
| 1179816 | 449111 | 449130 | TGTAGATCCTGGCAAGTATG | 79 | 2362 |
| 1179819 | 449158 | 449177 | TCAACATTATATCGATGCAA | 66 | 2363 |
| 1179821 | 449162 | 449181 | CTTGTCAACATTATATCGAT | 61 | 2364 |
| 1179823 | 449164 | 449183 | AACTTGTCAACATTATATCG | 79 | 2365 |
| 1179824 | 448294 | 448313 | GTTTCGCAATAAGATTCCAT | 98 | 2366 |
| 1179835 | 457231 | 457250 | TTAGCTACTCACCCCTGTTC | 74 | 2367 |
| 1179836 | 457241 | 457260 | AGATAATGGCTTAGCTACTC | 63 | 2368 |
| 1179837 | 457290 | 457309 | AAAACGACCTAAAGACCTAG | 92 | 2369 |
| 1179839 | 457384 | 457403 | AGGATTCAATAGTGTAGGTG | 25 | 2370 |
| 1179841 | 457502 | 457521 | GCACACCTGGATTTCACTAC | 33 | 2371 |
| 1179843 | 457505 | 457524 | TTGGCACACCTGGATTTCAC | 28 | 2372 |
| 1179844 | 457674 | 457693 | ATAACTTACCTTGTTGCAAC | 65 | 2373 |
| 1179846 | 448600 | 448619 | TTGAGAAGAAAACCCTATCG | 82 | 2374 |
| 1179848 | 448736 | 448755 | ATATTTAGACCACGATAACT | 83 | 2375 |
| 1179850 | 449117 | 449136 | CCCTCTTGTAGATCCTGGCA | 51 | 2376 |

Example 3

Effect of 5-10-5 MOE Gapmer Modified Oligonucleotides on Human UBE3A-ATS RNA In Vitro, Single Dose Modified oligonucleotides complementary to human UBE3A-ATS nucleic acid were tested for their effect on UBE3A-ATS RNA levels in vitro, essentially as described in Example 1, except that human UBE3A-ATS primer probe set LTS01075 (forward sequence GCCCGAAGTGCCTAT-TCCTT, designated herein as SEQ ID NO: 5; reverse sequence TGGTCAGGAGAACATAGGCATAAA, designated herein as SEQ ID NO: 6; probe sequence ACTCCCAGGGTTGATGGGCTACATCC, designated herein as SEQ ID NO: 7) was used to measure RNA levels.

The modified oligonucleotides in the tables below are 5-10-5 gapmers. The gapmers are 20 nucleosides in length, wherein the central gap segment consists of ten 2'-β-D-deoxynucleosides and the 3' and 5' wing segments each consists of five 2'-MOE nucleosides. The sugar motif for the gapmer is (from 5' to 3'): eeeeedddddddddeeeee; wherein 'd' represents a 2'-β-D-deoxyribosyl sugar moiety, and 'e' represents a 2'-MOE sugar moiety. Each internucleoside linkage of Compound IDs 617456, 617457, 617460, 617461, and 617557 is a phosphorothioate internucleoside linkage. All other compounds have an internucleoside linkage motif of: soooossssssssssooss, wherein each "s" represents a phosphorothioate internucleoside linkage and each "o" represents a phosphodiester internucleoside linkage.

All cytosine residues are 5-methylcytosines.

"Start site" indicates the 5'-most nucleoside to which the modified oligonucleotide is complementary in the target nucleic acid. "Stop site" indicates the 3'-most nucleoside to which the modified oligonucleotide is complementary in the target nucleic acid. Each modified oligonucleotide listed in the Tables below is 100% complementary to SEQ ID NO: 1.

Reduction of UBE3A-ATS RNA is presented in the tables below as percent UBE3A-ATS RNA amount relative to untreated control (UTC) cells. The values marked with an asterisk (*) indicate that the modified oligonucleotide is complementary to the amplicon region of the primer probe set. Additional assays may be used to measure the potency and efficacy of the modified oligonucleotides complementary to the amplicon region.

TABLE 38

Reduction of UBE3A-ATS RNA by 7,000 nM 5-10-5 MOE gapmers with PS internucleoside linkages in vitro (35,000 cells/well)

| Compound Number | SEQ ID NO: 1 Start Site | SEQ ID NO: 1 Stop Site | Sequence (5' to 3') | UBE3A-ATS (% UTC) | SEQ ID NO |
|---|---|---|---|---|---|
| 617456 | 463905 | 463924 | CAACTGTTACCAAGACTTCA | 25 | 32 |
| 617457 | 465003 | 465022 | ATCTGCGAATAGAGGCCCTC | 14 | 33 |
| 617460 | 466539 | 466558 | TAGGTTGCATAAAGCCAGGC | 22 | 36 |
| 617461 | 466981 | 467000 | CACACATCTTGTTCCCTCAA | 15 | 37 |
| 617557 | 483977 | 483996 | ATCATGTGCATACCCAGGGT | 17 | 172 |
| 699779 | 463905 | 463924 | CAACTGTTACCAAGACTTCA | 42 | 32 |
| 749897 | 461087 | 461106 | AATAATATTACTGCCAAATG | 85 | 2676 |
| 749898 | 461222 | 461241 | TGAATCAATTTTCAATATTT | 104 | 2677 |
| 749899 | 461325 | 461344 | TTATAAACTTCAGCAGAGTC | 41 | 2678 |
| 749900 | 461397 | 461416 | GAGTTGTTATTTGCATTAAG | 44 | 2679 |
| 749901 | 461431 | 461450 | ATTAGCACTTCTATAACTGG | 49 | 2680 |
| 749902 | 461442 | 461461 | GCTCCTGACAAATTAGCACT | 91 | 1329 |
| 749903 | 461455 | 461474 | TCTTGGTAAGGCAGCTCCTG | 64 | 2681 |
| 749904 | 461467 | 461486 | TACTCATCATGATCTTGGTA | 54 | 2682 |
| 749905 | 461516 | 461535 | TAGACTAGTTGAAATCGGAA | 46 | 2683 |
| 749906 | 461556 | 461575 | AATTCTAAAAGTCCTCTCTT | 69 | 2684 |
| 749907 | 461590 | 461609 | TGTGAGATAATTCAGGAGGT | 11 | 2685 |
| 749908 | 461810 | 461829 | ATTCACTTTATAAACACTGA | 68 | 2686 |
| 749909 | 461895 | 461914 | CCCACAATTTGGTCCCATTG | 39 | 2687 |
| 749910 | 462029 | 462048 | GAATAGGGCTCTGCTTATTT | 57 | 2688 |
| 749911 | 462064 | 462083 | TTTTATGGCCCTCCCATCAG | 81 | 2689 |
| 749912 | 462098 | 462117 | CATGAATTTAATTCTTTAAA | 80 | 2690 |
| 749913 | 462126 | 462145 | CATTGTGGAATTAAATTAAC | 54 | 2691 |
| 749914 | 462141 | 462160 | TTTCTAATTCAATATCATTG | 59 | 2692 |
| 749915 | 462149 | 462168 | TCCTCTTATTTCTAATTCAA | 54 | 2693 |
| 749916 | 462159 | 462178 | CAAGAGATATTCCTCTTATT | 41 | 2694 |
| 749917 | 462212 | 462231 | CAATAAATAGGTCAGAAATG | 84 | 2695 |
| 749918 | 462406 | 462425 | CTAAGTTTCTTAAGGTAAAA | 65 | 2696 |
| 749919 | 462607 | 462626 | CATTTTCAAATATTGGTATT | 77 | 2697 |
| 749920 | 462625 | 462644 | TAATGATTTGCCCTCCTACA | 51 | 2698 |

TABLE 38-continued

Reduction of UBE3A-ATS RNA by 7,000 nM 5-10-5 MOE gapmers with PS internucleoside linkages in vitro (35,000 cells/well)

| Compound Number | SEQ ID NO: 1 Start Site | SEQ ID NO: 1 Stop Site | Sequence (5' to 3') | UBE3A-ATS (% UTC) | SEQ ID NO |
|---|---|---|---|---|---|
| 749921 | 462626 | 462645 | GTAATGATTTGCCCTCCTAC | 26 | 1702 |
| 749922 | 462674 | 462693 | CCTTTTAAATAATTTTTCCT | 66 | 2699 |
| 749923 | 462992 | 463011 | AAAATGTTGGCATACATTTT | 70 | 2700 |
| 749924 | 462993 | 463012 | AAAAATGTTGGCATACATTT | 69 | 2701 |
| 749925 | 463248 | 463267 | CCTGGGTATTGCTGTCCAAA | 36 | 2702 |
| 749926 | 463307 | 463326 | TATGTTCCTAAGGAATAATG | 113 | 2703 |
| 749927 | 463318 | 463337 | TTCTTTGCATTTATGTTCCT | 40 | 2704 |
| 749928 | 463319 | 463338 | TTTCTTTGCATTTATGTTCC | 36 | 2705 |
| 749929 | 463453 | 463472 | TTACTCTGACTTTCCAGAAG | 70 | 2706 |
| 749930 | 463474 | 463493 | GGAGTAGATTTTGGAGTTT | 43 | 2707 |
| 749931 | 463512 | 463531 | TCAACTATTTCTATCAAGGC | 22 | 2708 |
| 749932 | 463519 | 463538 | ATTAATTTCAACTATTTCTA | 87 | 2709 |
| 749933 | 463601 | 463620 | TCTTACTGATTCAGCCATTT | 27 | 2710 |
| 749934 | 463663 | 463682 | TCTCAGCACTAGGGAGAAAA | 56 | 2711 |
| 749935 | 463695 | 463714 | AGTGGTTGCTATCCTGCTAA | 71 | 2000 |
| 749936 | 463788 | 463807 | AATATAAATCCTATAGATTG | 71 | 2712 |
| 749937 | 463805 | 463824 | CTGAGTCAGTCCAAATGAAT | 40 | 2713 |
| 749938 | 463840 | 463859 | TACCTTGAAATTGAGATTTC | 50 | 2714 |
| 749939 | 463853 | 463872 | TCTTTTTGACCAATACCTTG | 34 | 2715 |
| 749940 | 463871 | 463890 | TCAACAATTGCCATGGATTC | 78 | 2716 |
| 749941 | 463895 | 463914 | CAAGACTTCAGGCAGTTGTG | 54 | 2717 |
| 749942 | 463898 | 463917 | TACCAAGACTTCAGGCAGTT | 51 | 2718 |
| 749943 | 463900 | 463919 | GTTACCAAGACTTCAGGCAG | 35 | 2719 |
| 749944 | 463903 | 463922 | ACTGTTACCAAGACTTCAGG | 37 | 2720 |
| 749945 | 463907 | 463926 | CCCAACTGTTACCAAGACTT | 27 | 2721 |
| 749946 | 463910 | 463929 | TATCCCAACTGTTACCAAGA | 37 | 2722 |
| 749947 | 463912 | 463931 | TTTATCCCAACTGTTACCAA | 29 | 2723 |
| 749948 | 463915 | 463934 | TTGTTTATCCCAACTGTTAC | 42 | 2724 |
| 749949 | 463926 | 463945 | TGATCAGCTTCTTGTTTATC | 29 | 2725 |
| 749950 | 464355 | 464374 | CCAGAGCATAAAAGGAAAGC | 87 | 2726 |
| 749951 | 464377 | 464396 | TCACAACTCTTCCTTAGCTT | 28 | 2727 |
| 749952 | 464525 | 464544 | CAGTTAGGTTAGTGCACAGA | 44 | 2728 |
| 749953 | 464530 | 464549 | CTGCTCAGTTAGGTTAGTGC | 31 | 2729 |
| 749954 | 464542 | 464561 | ATACTGAAGTCTCTGCTCAG | 53 | 2730 |
| 749955 | 464738 | 464757 | TGTGCCATATTTTTCTATTT | 41 | 2731 |
| 749956 | 464993 | 465012 | AGAGGCCCTCTTGTTTCAAT | 36 | 2732 |

TABLE 38-continued

Reduction of UBE3A-ATS RNA by 7,000 nM 5-10-5 MOE gapmers with PS internucleoside linkages in vitro (35,000 cells/well)

| Compound Number | SEQ ID NO: 1 Start Site | SEQ ID NO: 1 Stop Site | Sequence (5' to 3') | UBE3A-ATS (% UTC) | SEQ ID NO |
|---|---|---|---|---|---|
| 749957 | 464996 | 465015 | AATAGAGGCCCTCTTGTTTC | 42 | 2733 |
| 749958 | 464998 | 465017 | CGAATAGAGGCCCTCTTGTT | 59 | 2734 |
| 749959 | 465001 | 465020 | CTGCGAATAGAGGCCCTCTT | 35 | 2735 |
| 749960 | 465003 | 465022 | ATCTGCGAATAGAGGCCCTC | 30 | 33 |
| 749961 | 465005 | 465024 | AAATCTGCGAATAGAGGCCC | 33 | 2736 |
| 749962 | 465008 | 465027 | CTCAAATCTGCGAATAGAGG | 34 | 2737 |
| 749963 | 465010 | 465029 | TGCTCAAATCTGCGAATAGA | 67 | 2738 |
| 749964 | 465013 | 465032 | GCCTGCTCAAATCTGCGAAT | 24 | 2739 |
| 749965 | 465050 | 465069 | AGTTGACATATCTTCAAGTT | 69 | 2740 |
| 749966 | 465057 | 465076 | TAATCTCAGTTGACATATCT | 55 | 2741 |
| 749967 | 465059 | 465078 | GATAATCTCAGTTGACATAT | 42 | 2742 |

Example 4

Effect of Modified Oligonucleotides on Human UBE3A-ATS RNA In Vitro, Multiple Doses Modified oligonucleotides selected from the examples above were tested at various doses in human IPS derived iCell GABANeurons (Cellular Dynamics). Cells were plated at a density of 35,000-60,000 cells per well, maintained per manufacturer instructions, and treated with modified oligonucleotides by free uptake at various concentrations as specified in the tables below. After a treatment period of approximately 6 days, total RNA was isolated from the cells and UBE3A-ATS RNA levels were measured by quantitative real-time PCR. Human UBE3A-ATS primer probe set RTS4796, described hereinabove, was used to measure RNA levels. UBE3A-ATS RNA levels were normalized according to total RNA content, as measured by RIBOGREEN®. Reduction of UBE3A-ATS RNA is presented in the tables below as percent UBE3A-ATS RNA amount relative to untreated control (UTC) cells.

Where possible, the half maximal inhibitory concentration ($IC_{50}$) of each modified oligonucleotide was calculated using a linear regression on a log/linear plot of the data in excel. In some cases, an $IC_{50}$ could not be reliably calculated and the data point is marked as "N.C.". Values marked with "N.D." indicate that a value was not determined in this experiment.

TABLE 39

Dose-dependent percent reduction of human UBE3A-ATS RNA in vitro (60,000 cells/well)

| Compound Number | UBE3A-ATS expression (% UTC) | | | |
|---|---|---|---|---|
|  | 740.7 nM | 2,222 nM | 6,666 nM | 20,000 nM |
| 617456 | 43 | 35 | 16 | 11 |
| 617457 | 38 | 32 | 27 | 18 |
| 617460 | 28 | 29 | 24 | 15 |

TABLE 39-continued

Dose-dependent percent reduction of human UBE3A-ATS RNA in vitro (60,000 cells/well)

| Compound Number | UBE3A-ATS expression (% UTC) | | | |
|---|---|---|---|---|
|  | 740.7 nM | 2,222 nM | 6,666 nM | 20,000 nM |
| 617461 | 40 | 19 | 11 | 12 |
| 617557 | 23 | 18 | 20 | 16 |

TABLE 40

Dose-dependent percent reduction of human UBE3A-ATS RNA in vitro (60,000 cells/well)

| Compound Number | UBE3A-ATS expression (% UTC) | | | |
|---|---|---|---|---|
|  | 740.7 nM | 2,222 nM | 6,666 nM | 20,000 nM |
| 617456 | 48 | 38 | 17 | 15 |
| 617457 | 35 | 27 | 18 | 18 |
| 617460 | 29 | 31 | 24 | 18 |
| 617461 | 38 | 24 | 13 | 12 |
| 617557 | 23 | 17 | 14 | 13 |

TABLE 41

Dose-dependent percent reduction of human UBE3A-ATS RNA in vitro (60,000 cells/well)

| Compound Number | UBE3A-ATS expression (% UTC) | | | | $IC_{50}$ (µM) |
|---|---|---|---|---|---|
|  | 740.7 nM | 2,222 nM | 6,666 nM | 20,000 nM |  |
| 617456 | 41 | 26 | 15 | 20 | N.C. |
| 617557 | 69 | 43 | 24 | 30 | 1.9 |
| 749969 | 46 | 15 | 12 | 5 | N.C. |
| 749991 | 43 | 27 | 19 | 13 | N.C. |
| 750028 | 54 | 31 | 24 | 15 | N.C. |
| 750030 | 57 | 37 | 23 | 14 | 1.0 |
| 750032 | 40 | 18 | 14 | 7 | N.C. |
| 750326 | 76 | 60 | 38 | 25 | 3.8 |

TABLE 41-continued

Dose-dependent percent reduction of human UBE3A-ATS RNA in vitro (60,000 cells/well)

| Compound Number | UBE3A-ATS expression (% UTC) | | | | IC$_{50}$ (µM) |
|---|---|---|---|---|---|
| | 740.7 nM | 2,222 nM | 6,666 nM | 20,000 nM | |
| 750329 | 60 | 57 | 33 | 16 | 2.1 |
| 750344 | 63 | 77 | 49 | 29 | 5.6 |
| 750350 | 67 | 71 | 59 | 35 | 8.6 |
| 750359 | 110 | 56 | 38 | 41 | 6.7 |
| 750360 | 69 | 47 | 39 | 38 | 3.3 |
| 750365 | 58 | 60 | 38 | 22 | 2.4 |
| 750366 | 87 | 58 | 44 | 24 | 4.6 |
| 750386 | 76 | 57 | 42 | 40 | 5.3 |
| 750517 | 30 | 25 | 12 | 8 | N.C. |
| 750519 | 45 | 23 | 10 | 8 | N.C. |
| 750542 | 96 | 71 | 55 | 41 | 9.9 |
| 750549 | 92 | 54 | 40 | 24 | 4.3 |

TABLE 42

Dose-dependent percent reduction of human UBE3A-ATS RNA in vitro (60,000 cells/well)

| Compound Number | UBE3A-ATS expression (% UTC) | | | | IC$_{50}$ (µM) |
|---|---|---|---|---|---|
| | 740.7 nM | 2,222 nM | 6,666 nM | 20,000 nM | |
| 617557 | 85 | 57 | 37 | 25 | 4.1 |
| 749861 | 47 | 31 | 25 | 14 | N.C. |
| 749863 | 83 | 52 | 34 | 23 | 3.5 |
| 749869 | 46 | 30 | 18 | 11 | N.C. |
| 749882 | 84 | 60 | 40 | 27 | 4.5 |
| 749885 | 61 | 53 | 31 | 20 | 2.0 |
| 749893 | 63 | 36 | 25 | 13 | 1.3 |
| 749894 | 28 | 21 | 10 | 11 | N.C. |
| 750040 | 78 | 59 | 46 | 32 | 5.1 |
| 750051 | 47 | 18 | 21 | 23 | N.C. |
| 750092 | 80 | 54 | 40 | 28 | 3.9 |
| 750100 | 82 | 67 | 59 | 51 | N.C. |
| 750270 | 43 | 34 | 25 | 21 | N.C. |
| 750292 | 58 | 37 | 28 | 26 | 1.0 |
| 750312 | 57 | 54 | 41 | 30 | 2.3 |
| 750325 | 101 | 94 | 68 | 46 | 18.4 |
| 750413 | 98 | 60 | 35 | 28 | 4.9 |
| 750416 | 94 | 48 | 38 | 15 | 3.7 |
| 750430 | 85 | 47 | 33 | 24 | 3.3 |
| 750431 | 136 | 125 | 90 | 62 | N.C. |

TABLE 43

Dose-dependent percent reduction of human UBE3A-ATS RNA in vitro (35,000 cells/well)

| Compound Number | UBE3A-ATS expression (% UTC) | | | | IC$_{50}$ (µM) |
|---|---|---|---|---|---|
| | 740.7 nM | 2,222 nM | 6,666 nM | 20,000 nM | |
| 617459 | 118 | 69 | 33 | 20 | 5.4 |
| 617470 | 84 | 51 | 28 | 13 | 2.9 |
| 617473 | 44 | 33 | 30 | 20 | N.C. |
| 617536 | 100 | 54 | 57 | 24 | 5.9 |
| 617547 | 122 | 52 | 29 | 18 | 4.6 |
| 617593 | 81 | 75 | 32 | 21 | 4.2 |
| 749794 | 89 | 102 | 66 | 52 | N.C. |
| 750418 | 135 | 132 | 105 | 51 | N.C. |
| 750439 | 98 | 60 | 44 | 26 | 5.4 |
| 750452 | 113 | 94 | 78 | 51 | N.C. |

TABLE 44

Dose-dependent percent reduction of human UBE3A-ATS RNA in vitro (35,000 cells/well)

| Compound Number | UBE3A-ATS expression (% UTC) | | | | IC$_{50}$ (µM) |
|---|---|---|---|---|---|
| | 740.7 nM | 2,222 nM | 6,666 nM | 20,000 nM | |
| 617557 | 129 | 53 | 32 | 28 | 5.5 |
| 749796 | 84 | 31 | 29 | 17 | 2.3 |
| 749816 | 94 | 56 | 46 | 22 | 4.8 |
| 749907 | 65 | 57 | 21 | 16 | 2.1 |
| 749921 | 50 | 47 | 25 | 18 | 1.0 |
| 749931 | 246 | 39 | 32 | 12 | 6.3 |
| 749933 | 51 | 41 | 26 | 11 | 0.9 |
| 749937 | 74 | 46 | 27 | 16 | 2.3 |
| 749944 | 116 | N/A | 74 | 40 | 15.3 |
| 749956 | 136 | 74 | 18 | 27 | 5.7 |
| 749964 | 75 | 80 | 35 | 17 | 4.2 |
| 750131 | 73 | 50 | 36 | 25 | 2.9 |
| 750139 | 35 | 29 | 21 | 15 | N.C. |
| 750140 | 27 | 27 | 13 | 11 | N.C. |
| 750141 | 52 | 61 | 25 | 24 | 1.6 |
| 750196 | 107 | 95 | 129 | 47 | N.C. |
| 750210 | 53 | 38 | 26 | 23 | 0.8 |
| 750214 | 34 | 70 | 47 | 41 | N.C. |
| 750228 | 109 | 105 | 95 | 70 | N.C. |
| 750242 | 77 | 70 | 36 | 15 | 3.8 |

TABLE 45

Dose-dependent percent reduction of human UBE3A-ATS RNA in vitro (35,000 cells/well)

| Compound Number | UBE3A-ATS expression (% UTC) | | | | IC$_{50}$ (µM) |
|---|---|---|---|---|---|
| | 740.7 nM | 2,222 nM | 6,666 nM | 20,000 nM | |
| 617557 | 80 | 59 | 31 | 13 | 3.1 |
| 750519 | 87 | 67 | 41 | 27 | 5.2 |
| 1065438 | 120 | 90 | 88 | 95 | N.C. |
| 1065582 | 65 | 61 | 41 | 29 | 3.4 |
| 1065597 | 142 | 135 | 111 | 103 | N.C. |
| 1065599 | 63 | 47 | 47 | 26 | 2.5 |
| 1065613 | 96 | 70 | 65 | 39 | 11.5 |
| 1065631 | 60 | 61 | 48 | 26 | 3.4 |
| 1065644 | 64 | 65 | 42 | 27 | 3.8 |
| 1065645 | 68 | 50 | 36 | 19 | 2.4 |
| 1065646 | 52 | 55 | 34 | 16 | 1.5 |
| 1065676 | 50 | 38 | 33 | 23 | N.C. |
| 1065690 | 56 | 53 | 38 | 24 | 1.9 |
| 1065754 | 74 | 56 | 57 | 27 | 5.1 |
| 1065817 | 94 | 76 | 42 | 38 | 7.6 |
| 1065899 | 59 | 56 | 46 | 30 | 3.0 |
| 1066072 | 133 | 108 | 86 | 63 | N.C. |
| 1066249 | 73 | 60 | 70 | 48 | N.C. |
| 1066378 | 116 | 114 | 87 | 52 | N.C. |

TABLE 46

Dose-dependent percent reduction of human UBE3A-ATS RNA by modified oligonucleotides in vitro (42,000 cells/well)

| Compound Number | UBE3A-ATS expression (% UTC) | | | | IC$_{50}$ (µM) |
|---|---|---|---|---|---|
| | 740.7 nM | 2,222 nM | 6,666 nM | 20,000 nM | |
| 617557 | 83 | 54 | 31 | 13 | 3.1 |
| 750519 | 63 | 48 | 43 | 26 | 2.4 |
| 1065578 | 77 | 36 | 36 | 24 | 2.4 |
| 1065579 | 55 | 58 | 30 | 66 | N.C. |
| 1065595 | 75 | 60 | 32 | 19 | 3.1 |
| 1065642 | 52 | 58 | 40 | 27 | 2.0 |
| 1065672 | 85 | 67 | 42 | 18 | 4.5 |
| 1065674 | 64 | 69 | 40 | 22 | 3.5 |
| 1065719 | 76 | 62 | 46 | 38 | 6.1 |

TABLE 46-continued

Dose-dependent percent reduction of human UBE3A-ATS RNA by modified oligonucleotides in vitro (42,000 cells/well)

| Compound Number | UBE3A-ATS expression (% UTC) | | | | IC$_{50}$ (µM) |
|---|---|---|---|---|---|
| | 740.7 nM | 2,222 nM | 6,666 nM | 20,000 nM | |
| 1065750 | 38 | 28 | 25 | 28 | N.C. |
| 1065766 | 78 | 52 | 32 | 37 | 3.7 |
| 1065768 | 86 | 66 | 43 | 30 | 5.5 |
| 1065799 | 66 | 52 | 41 | 34 | 3.2 |
| 1065863 | 54 | 60 | 46 | 27 | 2.6 |
| 1065894 | 82 | 100 | 52 | 52 | N.C. |
| 1066037 | 66 | 70 | 56 | 62 | N.C. |
| 1066119 | 82 | 116 | 101 | 72 | N.C. |
| 1066375 | 116 | 98 | 68 | 77 | N.C. |
| 1066423 | 39 | 70 | 63 | 46 | N.C. |

TABLE 47

Dose-dependent percent reduction of human UBE3A-ATS RNA in vitro (42,000 cells/well)

| Compound Number | UBE3A-ATS expression (% UTC) | | | | IC$_{50}$ (µM) |
|---|---|---|---|---|---|
| | 740.7 nM | 2,222 nM | 6,666 nM | 20,000 nM | |
| 617557 | 65 | 52 | 23 | 8 | 1.9 |
| 1065324 | 86 | 90 | 67 | 43 | 18.4 |
| 1065369 | 107 | 91 | 108 | 83 | N.C. |
| 1065465 | 97 | 96 | 97 | 100 | N.C. |
| 1065513 | 156 | 104 | 66 | 70 | N.C. |
| 1065558 | 116 | 125 | 92 | 112 | N.C. |
| 1065592 | 85 | 84 | 50 | 23 | 6.5 |
| 1065624 | 87 | 71 | 39 | 20 | 4.7 |
| 1065667 | 64 | 59 | 35 | 21 | 2.7 |
| 1065747 | 91 | 65 | 55 | N/A | N.C. |
| 1065955 | 84 | 55 | 43 | 23 | 4.1 |
| 1066002 | 94 | 75 | 68 | 50 | N.C. |
| 1066003 | 90 | 73 | 49 | 43 | 9.5 |
| 1066034 | 137 | 120 | 101 | 67 | N.C. |
| 1066201 | 98 | 110 | 84 | 79 | N.C. |
| 1066273 | 101 | 95 | 108 | 104 | N.C. |
| 1066359 | 111 | 96 | 101 | 81 | N.C. |
| 1066420 | 70 | 43 | 27 | 33 | 2.2 |

TABLE 48

Dose-dependent percent reduction of human UBE3A-ATS RNA in vitro (42,000 cells/well)

| Compound Number | UBE3A-ATS expression (% UTC) | | | | IC$_{50}$ (µM) |
|---|---|---|---|---|---|
| | 740.7 nM | 2,222 nM | 6,666 nM | 20,000 nM | |
| 617557 | 70 | 46 | 23 | 10 | 1.9 |
| 1065654 | 96 | 87 | 54 | 43 | 11.9 |
| 1065680 | 78 | 63 | 41 | 28 | 4.5 |
| 1065686 | 63 | 64 | 62 | 24 | 5.1 |
| 1065735 | 102 | 66 | 41 | 41 | 7.4 |
| 1065785 | 81 | 74 | 52 | 50 | 14.7 |
| 1065829 | 64 | 59 | 45 | 31 | 3.7 |
| 1065858 | 69 | 49 | 28 | 23 | 2.2 |
| 1065859 | 52 | 36 | 28 | 20 | N.C. |
| 1065901 | 89 | 69 | 73 | 55 | N.C. |
| 1065914 | 108 | 111 | 82 | 74 | N.C. |
| 1065977 | 106 | 87 | 101 | 76 | N.C. |
| 1066009 | 88 | 71 | 130 | 84 | N.C. |
| 1066046 | 84 | 59 | 43 | 36 | 5.5 |
| 1066089 | 46 | 71 | 58 | 41 | N.C. |
| 1066217 | 67 | 64 | 46 | 41 | 6.5 |
| 1066221 | 59 | 49 | 39 | 31 | 2.0 |
| 1066311 | 93 | 75 | 73 | 49 | N.C. |

TABLE 48-continued

Dose-dependent percent reduction of human UBE3A-ATS RNA in vitro (42,000 cells/well)

| Compound Number | UBE3A-ATS expression (% UTC) | | | | IC$_{50}$ (µM) |
|---|---|---|---|---|---|
| | 740.7 nM | 2,222 nM | 6,666 nM | 20,000 nM | |
| 1066377 | 94 | 73 | 51 | 35 | 7.9 |
| 1066396 | 100 | 75 | 82 | 54 | N.C. |

TABLE 49

Dose-dependent percent reduction of human UBE3A-ATS RNA in vitro (42,000 cells/well)

| Compound Number | UBE3A-ATS expression (% UTC) | | | | IC$_{50}$ (µM) |
|---|---|---|---|---|---|
| | 740.7 nM | 2,222 nM | 6,666 nM | 20,000 nM | |
| 617557 | 66 | 47 | 21 | 6 | 1.7 |
| 750519 | 75 | 58 | 36 | 25 | 3.5 |
| 1065272 | 90 | 63 | 38 | 33 | 5.4 |
| 1065576 | 21 | 28 | 19 | 13 | N.C. |
| 1065590 | 74 | 49 | 31 | 27 | 2.8 |
| 1065591 | 83 | 60 | 29 | 13 | 3.2 |
| 1065607 | 68 | 47 | 28 | 17 | 2.1 |
| 1065608 | 72 | 38 | 18 | 13 | 1.7 |
| 1065623 | 46 | 28 | 21 | 13 | N.C. |
| 1065669 | 89 | 75 | 57 | 28 | 7.6 |
| 1065685 | 64 | 34 | 19 | 20 | 1.2 |
| 1065795 | 100 | 86 | 56 | 38 | 10.8 |
| 1065810 | 62 | 46 | 23 | 22 | 1.6 |
| 1065812 | 77 | 67 | 36 | 24 | 4.1 |
| 1065826 | 108 | 93 | 54 | 43 | 12.1 |
| 1065937 | 86 | 61 | 60 | 37 | 8.7 |
| 1065953 | 77 | 46 | 34 | 29 | 3.0 |
| 1065954 | 78 | 62 | 45 | 38 | 6.1 |
| 1066097 | 133 | 121 | 119 | 125 | N.C. |

TABLE 50

Dose-dependent percent reduction of human UBE3A-ATS RNA in vitro (42,000 cells/well)

| Compound Number | UBE3A-ATS expression (% UTC) | | | | IC$_{50}$ (µM) |
|---|---|---|---|---|---|
| | 740.7 nM | 2,222 nM | 6,666 nM | 20,000 nM | |
| 617557 | 39 | 43 | 25 | 13 | N.C. |
| 750519 | 44 | 36 | 34 | 17 | N.C. |
| 1065605 | 50 | 48 | 29 | 19 | N.C. |
| 1065619 | 95 | 73 | 47 | 5 | 4.6 |
| 1065621 | 5 | 63 | 44 | 21 | 4.6 |
| 1065635 | 48 | 29 | 19 | 4 | N.C. |
| 1065651 | 13 | 8 | 29 | 10 | N.C. |
| 1065696 | 77 | 71 | 61 | 7 | 4.7 |
| 1065712 | 58 | 40 | 34 | 20 | 1.3 |
| 1065713 | 4 | 4 | 7 | 6 | N.C. |
| 1065728 | 73 | 54 | 42 | 25 | 3.5 |
| 1065823 | 7 | 9 | 10 | N/A | N.C. |
| 1065840 | 73 | 61 | 41 | 32 | 4.4 |
| 1065856 | 78 | 49 | 37 | 24 | 3.2 |
| 1065857 | 10 | 61 | 49 | 28 | 5.1 |
| 1065889 | 58 | 81 | 61 | 62 | N.C. |
| 1065903 | 85 | 65 | 60 | 6 | 4.6 |
| 1065920 | 53 | 42 | 40 | 26 | 1.0 |
| 1066350 | 89 | 101 | 78 | 21 | 11.3 |

TABLE 51

Dose-dependent percent reduction of human UBE3A-ATS RNA in vitro (42,000 cells/well)

| Compound Number | UBE3A-ATS expression (% UTC) | | | | IC$_{50}$ (μM) |
|---|---|---|---|---|---|
| | 740.7 nM | 2,222 nM | 6,666 nM | 20,000 nM | |
| 617557 | 14 | 16 | 3 | 0 | N.C. |
| 750519 | 31 | 27 | 22 | 12 | N.C. |
| 1065296 | 78 | 56 | 45 | 7 | 3.2 |
| 1065330 | 13 | 5 | 4 | 3 | N.C. |
| 1065586 | 5 | 44 | 22 | 11 | N.C. |
| 1065600 | 79 | 55 | 36 | 4 | 2.9 |
| 1065616 | 84 | 75 | 65 | 5 | 5.4 |
| 1065708 | 9 | 8 | 6 | N/A | N.C. |
| 1065709 | 6 | 4 | 4 | 4 | N.C. |
| 1065710 | 52 | 33 | 16 | 9 | N.C. |
| 1065821 | 110 | 58 | 29 | 16 | 4.3 |
| 1065868 | 73 | 42 | 28 | 6 | 2.0 |
| 1065902 | 8 | 60 | 35 | 24 | 3.6 |
| 1065932 | 51 | 42 | 35 | 17 | 0.9 |
| 1065947 | 65 | 48 | 38 | 10 | 2.1 |
| 1066076 | 81 | 76 | 41 | 22 | 5.0 |
| 1066092 | 80 | 49 | 40 | 27 | 3.6 |
| 1066253 | 0 | 71 | 31 | 21 | 4.5 |
| 1066429 | 28 | 17 | 6 | 6 | N.C. |

TABLE 52

Dose-dependent percent reduction of human UBE3A-ATS RNA in vitro (42,000 cells/well)

| Compound Number | UBE3A-ATS expression (% UTC) | | | | IC$_{50}$ (μM) |
|---|---|---|---|---|---|
| | 740.7 nM | 2,222 nM | 6,666 nM | 20,000 nM | |
| 617557 | 37 | 17 | 29 | 12 | N.C. |
| 750519 | 50 | 40 | 40 | 20 | N.C. |
| 1065295 | 78 | 73 | 74 | 49 | N.C. |
| 1065473 | 31 | 29 | 16 | 11 | N.C. |
| 1065503 | 105 | 107 | 107 | 77 | N.C. |
| 1065561 | 66 | 44 | 21 | 13 | 1.7 |
| 1065593 | 59 | 45 | 30 | 6 | 1.5 |
| 1065609 | 59 | 50 | 34 | 6 | 1.7 |
| 1065625 | 70 | 56 | 41 | 22 | 3.2 |
| 1065641 | 43 | 31 | 18 | 7 | N.C. |
| 1065671 | 55 | 49 | 30 | 8 | 1.4 |
| 1065678 | 75 | 78 | 54 | 33 | 8.0 |
| 1065765 | 64 | 46 | 28 | 12 | 1.8 |
| 1065791 | 7 | 58 | 44 | 30 | 4.1 |
| 1065806 | 24 | 72 | 82 | 74 | N.C. |
| 1065813 | 12 | 11 | 11 | 7 | N.C. |
| 1065924 | 107 | 94 | 79 | 41 | 18.4 |
| 1066011 | 94 | 85 | 83 | 50 | N.C. |
| 1066220 | 24 | 83 | 75 | 62 | N.C. |

TABLE 53

Dose-dependent percent reduction of human UBE3A-ATS RNA in vitro (40,000 cells/well)

| Compound Number | UBE3A-ATS expression (% UTC) | | | | IC$_{50}$ (μM) |
|---|---|---|---|---|---|
| | 740.7 nM | 2,222 nM | 6,666 nM | 20,000 nM | |
| 750519 | 83 | 53 | 21 | 14 | 2.8 |
| 1165521 | 55 | 38 | 32 | 27 | 0.9 |
| 1165524 | 42 | 33 | 26 | 14 | N.C. |
| 1165536 | 47 | 39 | 32 | 21 | N.C. |
| 1165545 | 62 | 49 | 32 | 33 | 2.0 |
| 1165552 | 53 | 35 | 24 | 16 | 0.8 |
| 1165553 | 55 | 34 | 24 | 18 | 0.8 |
| 1165554 | 63 | 55 | 29 | 19 | 2.1 |
| 1165555 | 53 | 43 | 21 | 22 | 0.9 |
| 1165562 | 72 | 69 | 35 | 23 | 3.8 |
| 1165577 | 65 | 59 | 33 | 28 | 2.8 |
| 1165588 | 78 | 57 | 33 | 38 | 4.3 |
| 1165590 | 44 | 41 | 30 | 21 | N.C. |
| 1165593 | 85 | 92 | 83 | 50 | N.C. |
| 1165611 | 47 | 39 | 25 | 21 | N.C. |
| 1165724 | 80 | 71 | 57 | 54 | N.C. |
| 1165788 | 66 | 71 | 42 | 25 | 4.2 |
| 1165798 | 73 | 81 | 86 | 52 | N.C. |
| 1179842 | 78 | 37 | 27 | 20 | 2.2 |

Example 5

Effect of Modified Oligonucleotides on Human UBE3A-ATS RNA In Vitro, Multiple Doses Modified oligonucleotides selected from the examples above were tested at various doses in human IPS derived ReproNeuro™ Neurons (Repro CELL). Cells were plated at a density of 20,000 cells per well, maintained per manufacturer instructions, and treated with modified oligonucleotides by free uptake at various concentrations as specified in the tables below. After a treatment period of approximately 5 days, total RNA was isolated from the cells and UBE3A-ATS RNA levels were measured by quantitative real-time PCR. Human UBE3A-ATS primer probe set RTS4796, described hereinabove, was used to measure RNA levels. UBE3A-ATS RNA levels were normalized according to total RNA content, as measured by RIBOGREEN®. Reduction of UBE3A-ATS RNA is presented in the tables below as percent UBE3A-ATS RNA amount relative to untreated control (UTC) cells.

The half maximal inhibitory concentration (IC$_{50}$) of each modified oligonucleotide was calculated using a linear regression on a log/linear plot of the data in excel. In cases where IC$_{50}$ could not be calculated, IC$_{50}$s are marked as N.C. (Not Calculated).

TABLE 54

Dose-dependent percent reduction of human UBE3A-ATS RNA in vitro

| Compound Number | UBE3A-ATS expression (% UTC) | | | | IC$_{50}$ (μM) |
|---|---|---|---|---|---|
| | 740.7 nM | 2,222 nM | 6,666 nM | 20,000 nM | |
| 750519 | 73 | 54 | 19 | 11 | 2.3 |
| 1165523 | 75 | 60 | 43 | 33 | 4.7 |
| 1165533 | 60 | 50 | 18 | 33 | 1.5 |
| 1165538 | 64 | 47 | 34 | 26 | 2.1 |
| 1165550 | 65 | 62 | 47 | 32 | 4.5 |
| 1165563 | 69 | 51 | 41 | 29 | 3.1 |
| 1165586 | 62 | 50 | 35 | 32 | 2.3 |
| 1165596 | 88 | 72 | 69 | 43 | 16.4 |
| 1165608 | 88 | 89 | 62 | 54 | N.C. |
| 1165616 | 89 | 88 | 80 | 74 | N.C. |
| 1165694 | 71 | 57 | 55 | 50 | 15.0 |
| 1165737 | 71 | 55 | 53 | 46 | 9.1 |
| 1165827 | 72 | 59 | 65 | 42 | 13.6 |
| 1165855 | 60 | 60 | 37 | 19 | 2.5 |
| 1165897 | 78 | 76 | 54 | 50 | N.C. |
| 1179808 | 101 | 100 | 85 | 75 | N.C. |
| 1179839 | 58 | 41 | 26 | 23 | 1.2 |

TABLE 54-continued

Dose-dependent percent reduction of human UBE3A-ATS RNA in vitro

| Compound Number | UBE3A-ATS expression (% UTC) | | | | IC$_{50}$ (µM) |
|---|---|---|---|---|---|
| | 740.7 nM | 2,222 nM | 6,666 nM | 20,000 nM | |
| 1179841 | 68 | 45 | 38 | 26 | 2.4 |
| 1179843 | 52 | 57 | 36 | 21 | 1.7 |

Example 6

Effect of Modified Oligonucleotides on Human UBE3A-ATS RNA and UBE3A RNA In Vitro, Multiple Doses Modified oligonucleotides selected from the examples above were tested at various doses in 10-week differentiated human neuronal cells derived from Angelman Syndrome patient derived IPS cells (Protocols and cells described in Chamberlain S J., et al., *Induced pluripotent stem cell models of the genomic imprinting disorders Angelman and Prader-Willi syndromes*. PNAS, 2010. 41: 17668-17673). At the end of the 10-week differentiation period, cells were treated with modified oligonucleotides by free uptake at various concentrations as specified in the tables below. After a treatment period of approximately 6 days, total RNA was isolated from the cells. Both UBE3A-ATS RNA and UBE3A RNA levels were measured by quantitative real-time PCR. Human UBE3A-ATS primer probe set RTS4796 was used to measure UBE3A-ATS RNA levels as described above. Human UBE3A primer probe set RTS35984 (forward sequence CACCCTGATGTCACCGAATG, designated herein as SEQ ID NO: 8; reverse sequence GCGTTCTATTAGATGCTTTGCAG, designated herein as SEQ ID NO: 9; probe sequence ACTGAGGTTCTCCTGATCTTTTACAAGCTG, designated herein as SEQ ID NO: 10) was used to measure UBE3A RNA levels. RNA levels were adjusted according to total RNA content, as measured by RIBOGREEN®. Reduction of UBE3A-ATS RNA or induction of UBE3A RNA is presented in the tables below as percent UBE3A-ATS RNA amount or percent UBE3A RNA relative to untreated control (UTC) cells. Values marked with "N.D." indicate that a value was not determined in this experiment.

Several modified oligonucleotides were found to reduce UBE3A-ATS RNA accompanied by concurrent increase in UBE3A RNA in Angelman's patient IPS cell derived neurons.

TABLE 55

Reduction of UBE3A-ATS RNA and increase of UBE3A RNA in Angelman Syndrome IPS cell derived neurons

| Compound ID | UBE3A-ATS RNA (% UTC) (RTS4796) | | | UBE3A RNA (% UTC) (RTS35984) | | |
|---|---|---|---|---|---|---|
| | 741 nM | 2222 nM | 6667 nM | 741 nM | 2222 nM | 6667 nM |
| 617557 | 17 | 16 | N.D. | 142 | 151 | N.D. |
| 750140 | 7 | N.D. | N.D. | 226 | N.D. | N.D. |
| 750139 | 35 | 10 | 3 | 104 | 196 | 194 |
| 750131 | 29 | 25 | N.D. | 49 | 53 | N.D. |
| 750141 | 22 | N.D. | N.D. | 89 | N.D. | N.D. |
| 750242 | 42 | N.D. | N.D. | 45 | N.D. | N.D. |
| 750210 | 49 | 14 | 6 | 122 | 101 | 166 |
| 750214 | 53 | 56 | 13 | 87 | 154 | 85 |
| 749907 | 16 | 13 | 7 | 133 | 298 | 205 |
| 749931 | 35 | 17 | 11 | 152 | 271 | 260 |
| 749964 | 27 | 15 | 6 | 144 | 160 | 202 |
| 749921 | 25 | 12 | N.D. | 73 | 98 | N.D. |
| 749933 | 42 | 10 | 13 | 116 | 92 | 210 |
| 749956 | 51 | 33 | N.D. | 94 | 103 | N.D. |
| 749937 | 52 | 27 | 7 | 104 | 131 | 137 |
| 749796 | 73 | 67 | N.D. | 81 | 79 | N.D. |
| 749816 | 75 | N.D. | 19 | 63 | N.D. | 27 |
| 749969 | 33 | 14 | 10 | 171 | 249 | 305 |
| 749991 | 32 | 15 | 15 | 193 | 165 | 276 |

TABLE 56

Reduction of UBE3A-ATS RNA and increase of UBE3A RNA in Angelman Syndrome IPS cell derived neurons

| Compound ID | UBE3A-ATS RNA (% UTC) (RTS4796) | | | UBE3A RNA (% UTC) (RTS35984) | | |
|---|---|---|---|---|---|---|
| | 741 nM | 2222 nM | 6667 nM | 741 nM | 2222 nM | 6667 nM |
| 617557 | 54 | 51 | 39 | 144 | 365 | 252 |
| 750140 | 22 | 37 | N.D. | 345 | 328 | N.D. |
| 750517 | 34 | 30 | 19 | 269 | 328 | 418 |
| 750549 | 60 | 72 | 72 | 337 | 225 | 309 |
| 750542 | 64 | 70 | 22 | 98 | 113 | 234 |
| 617456 | 58 | 35 | 26 | 142 | 176 | 253 |
| 750519 | 33 | 26 | 18 | 374 | 440 | 447 |
| 750360 | 93 | 113 | 59 | 151 | 221 | 204 |
| 750359 | 32 | 31 | 27 | 267 | 134 | 229 |
| 750386 | 35 | 40 | 17 | 182 | 282 | 320 |
| 750366 | 77 | 45 | 37 | 87 | 122 | 185 |
| 750344 | 51 | 50 | 30 | 91 | 139 | 150 |
| 750326 | 67 | 49 | 31 | 106 | 108 | 166 |
| 750350 | 68 | 66 | 102 | 111 | 132 | 138 |
| 750365 | 74 | 63 | 37 | 122 | 160 | 183 |
| 750329 | 88 | 82 | N.D. | 154 | 148 | N.D. |
| 750028 | 81 | N.D. | 14 | 324 | N.D. | 448 |
| 750030 | 87 | 30 | 22 | 221 | 307 | 373 |
| 750032 | 47 | 17 | 13 | 202 | 323 | 254 |

TABLE 57

Reduction of UBE3A-ATS RNA and increase of UBE3A RNA in Angelman Syndrome IPS cell derived neurons

| Compound ID | UBE3A-ATS RNA (% UTC) (RTS4796) | | | UBE3A RNA (% UTC) (RTS35984) | | |
|---|---|---|---|---|---|---|
| | 741 nM | 2222 nM | 6667 nM | 741 nM | 2222 nM | 6667 nM |
| 617557 | 28 | 54 | N.D. | 318 | 411 | N.D. |
| 750140 | 19 | 20 | 10 | 619 | 542 | 132 |
| 750040 | 38 | 49 | 25 | 171 | 192 | 318 |
| 750051 | 21 | 21 | 13 | 106 | 544 | 416 |
| 750092 | 40 | 32 | 12 | 175 | 507 | 118 |
| 749894 | 12 | 19 | 6 | 143 | 2085 | 605 |
| 749869 | 10 | 11 | 13 | 376 | 802 | 1504 |
| 749882 | 34 | 31 | 19 | 502 | 907 | 926 |
| 749863 | 45 | 42 | 22 | 326 | 2584 | 927 |
| 749893 | 34 | 10 | 7 | 215 | 428 | 1023 |
| 749885 | 22 | 12 | 10 | 105 | 233 | 614 |

TABLE 57-continued

Reduction of UBE3A-ATS RNA and increase of UBE3A RNA in Angelman Syndrome IPS cell derived neurons

| Compound ID | UBE3A-ATS RNA (% UTC) (RTS4796) | | | UBE3A RNA (% UTC) (RTS35984) | | |
|---|---|---|---|---|---|---|
| | 741 nM | 2222 nM | 6667 nM | 741 nM | 2222 nM | 6667 nM |
| 749861 | 19 | 11 | 8 | 209 | 236 | 466 |
| 750292 | 28 | 15 | 13 | 123 | 318 | 645 |
| 750270 | 18 | 14 | 10 | 267 | 578 | 584 |
| 750312 | 39 | 19 | 12 | 87 | 289 | 420 |
| 750413 | 46 | 49 | 20 | 123 | 375 | 143 |
| 750416 | 49 | N.D. | N.D. | 119 | N.D. | N.D. |
| 750430 | 33 | 21 | 12 | 329 | 359 | 241 |
| 750439 | 40 | 31 | 19 | 188 | 197 | 183 |

TABLE 58

Reduction of UBE3A-ATS RNA and increase of UBE3A RNA in Angelman Syndrome IPS cell derived neurons

| Compound ID | UBE3A-ATS RNA (% UTC) (RTS4796) | | | UBE3A RNA (% UTC) (RTS35984) | | |
|---|---|---|---|---|---|---|
| | 741 nM | 2222 nM | 6667 nM | 741 nM | 2222 nM | 6667 nM |
| 617557 | 60 | 39 | N.D. | 266 | 161 | N.D. |
| 617557 | 65 | 23 | 8 | 229 | 204 | 122 |
| 750140 | 18 | 29 | N.D. | 312 | 222 | N.D. |
| 617470 | 36 | 34 | 23 | 141 | 191 | 317 |
| 617473 | 29 | 37 | 20 | 91 | 162 | 87 |
| 617459 | 38 | 18 | 8 | 80 | 155 | 191 |
| 617547 | 31 | 19 | 28 | 52 | 145 | 226 |
| 617536 | 83 | 28 | 109 | 165 | 108 | 265 |
| 617593 | 67 | 142 | 107 | 100 | 73 | 83 |
| 750544 | 98 | 107 | 51 | 221 | 258 | 307 |
| 750554 | 65 | 72 | 88 | 57 | 80 | 55 |
| 750540 | 46 | 26 | 29 | 202 | 344 | 458 |
| 750567 | 62 | 49 | 31 | 86 | 108 | 227 |
| 749984 | 47 | 42 | N.D. | 68 | 99 | 277 |
| 750009 | 31 | 39 | 22 | 65 | 92 | 217 |
| 749865 | 44 | N.D. | 12 | 201 | N.D. | 249 |
| 749860 | 36 | 22 | 9 | 285 | 265 | 263 |
| 750006 | 32 | 17 | 66 | 241 | 329 | 513 |
| 582468 | 102 | 79 | 33 | 120 | 33 | 62 |
| 141923 | 150 | 169 | 100 | 135 | 126 | 53 |

TABLE 59

Reduction of UBE3A-ATS RNA and increase of UBE3A RNA in Angelman Syndrome IPS cell derived neurons

| Compound ID | UBE3A-ATS RNA (% UTC) (RTS4796) | | | | UBE3A RNA (% UTC) (RTS35984) | | | |
|---|---|---|---|---|---|---|---|---|
| | 741 nM | 2222 nM | 6667 nM | 20000 nM | 741 nM | 2222 nM | 6667 nM | 20000 nM |
| 749894 | 20 | 13 | 11 | 10 | 301 | 200 | 159 | 546 |
| 749969 | 47 | 44 | 45 | 51 | 125 | 88 | 85 | 205 |
| 750032 | 16 | 17 | 12 | 17 | 215 | 190 | 182 | 236 |
| 750140 | 26 | 33 | 13 | 22 | 252 | 429 | 160 | 222 |
| 1065690 | 18 | 7 | 11 | 9 | 313 | 295 | 203 | 254 |
| 1065868 | 32 | 17 | 9 | 9 | 249 | 303 | 211 | 143 |
| 1065579 | 20 | 19 | 25 | 7 | 155 | 134 | 133 | 231 |
| 1065858 | 22 | 24 | 25 | 17 | 190 | 239 | 229 | 249 |
| 1065859 | 55 | 57 | 36 | 29 | 117 | 141 | 199 | 193 |
| 1065812 | 25 | 29 | 9 | 10 | 133 | 120 | 185 | 163 |
| 749860 | 35 | 21 | 14 | 11 | 129 | 250 | 196 | 278 |
| 1065593 | 18 | 10 | 7 | 9 | 228 | 181 | 211 | 261 |
| 1065953 | 15 | 11 | 12 | 10 | 148 | 269 | 243 | 221 |
| 1065856 | 15 | 18 | 11 | 9 | 292 | 286 | 103 | 234 |

TABLE 59-continued

Reduction of UBE3A-ATS RNA and increase of UBE3A RNA in Angelman Syndrome IPS cell derived neurons

| Compound ID | UBE3A-ATS RNA (% UTC) (RTS4796) | | | | UBE3A RNA (% UTC) (RTS35984) | | | |
|---|---|---|---|---|---|---|---|---|
| | 741 nM | 2222 nM | 6667 nM | 20000 nM | 741 nM | 2222 nM | 6667 nM | 20000 nM |
| 1065937 | 21 | 26 | 12 | 10 | 93 | 205 | 225 | 208 |
| 1065728 | 35 | 24 | 20 | 12 | 132 | 143 | 144 | 198 |
| 750139 | 38 | 28 | 13 | 14 | 176 | 229 | 248 | 315 |
| 617557 | 55 | 23 | 30 | 33 | 166 | 206 | 193 | 226 |
| 750519 | 15 | 15 | 5 | 3 | 173 | 101 | 220 | 324 |

TABLE 60

Reduction of UBE3A-ATS RNA and increase of UBE3A RNA in Angelman Syndrome IPS cell derived neurons

| Compound ID | UBE3A-ATS RNA (% UTC) (RTS4796) | | | | UBE3A RNA (% UTC) (RTS35984) | | | |
|---|---|---|---|---|---|---|---|---|
| | 741 nM | 2222 nM | 6667 nM | 20000 nM | 741 nM | 2222 nM | 6667 nM | 20000 nM |
| 1066092 | 138 | 160 | 98 | 55 | 247 | 253 | 254 | 111 |
| 1065902 | 92 | 85 | 55 | 42 | 168 | 231 | 203 | 304 |
| 1065840 | 57 | 54 | 37 | 22 | 209 | 176 | 141 | 307 |
| 1066253 | 77 | 37 | 52 | 36 | 182 | 167 | 184 | 236 |
| 1065785 | 93 | 35 | 41 | 54 | 155 | 198 | 225 | 240 |
| 1065821 | 40 | 19 | 20 | 20 | 220 | 288 | 215 | 276 |
| 750006 | 78 | 33 | 33 | 56 | 132 | 119 | 168 | 185 |
| 750028 | 36 | 17 | 16 | 19 | 173 | 235 | 189 | 216 |
| 617557 | 37 | 26 | 13 | 23 | 194 | 166 | 214 | 241 |

TABLE 61

Reduction of UBE3A-ATS RNA and increase of UBE3A RNA in Angelman Syndrome IPS cell derived neurons

| Compound ID | UBE3A-ATS RNA (% UTC) (RTS4796) | | | | UBE3A RNA (% UTC) (RTS35984) | | | |
|---|---|---|---|---|---|---|---|---|
| | 741 nM | 2222 nM | 6667 nM | 20000 nM | 741 nM | 2222 nM | 6667 nM | 20000 nM |
| 750519 | 41 | 26 | 11 | 8 | 138 | 158 | 148 | 158 |
| 1065671 | 106 | 81 | 108 | 61 | 213 | 189 | 387 | 235 |
| 617557 | 69 | 52 | 37 | 35 | 129 | 132 | 210 | 195 |
| 1065686 | 101 | 101 | 81 | 88 | 145 | 105 | 118 | 164 |
| 750359 | 121 | 70 | 79 | 48 | 108 | 119 | 134 | 131 |
| 1065817 | 75 | 78 | 40 | N.D. | 119 | 174 | 131 | N.D. |
| 750386 | 100 | 65 | 58 | 50 | 106 | 155 | 190 | 128 |
| 749894 | 58 | 40 | 19 | 20 | 176 | 187 | 159 | 244 |
| 1065591 | 68 | 51 | 52 | 34 | 138 | 132 | 227 | 155 |
| 750140 | 178 | 165 | 133 | 129 | 129 | 117 | 98 | 142 |
| 750032 | 95 | 56 | 40 | 31 | 109 | 144 | 126 | 172 |
| 1065599 | 73 | 45 | 42 | 33 | 135 | 131 | 188 | 210 |
| 1065690 | 66 | 48 | 35 | 29 | 182 | 175 | 211 | 185 |
| 1065868 | 132 | 125 | 107 | 90 | 93 | 125 | 113 | 99 |
| 1065645 | 83 | 47 | 50 | 25 | 169 | 144 | 287 | 158 |
| 1065858 | 78 | 46 | 22 | 18 | 175 | 192 | 162 | 227 |
| 1065856 | 76 | 66 | 49 | 35 | 138 | 195 | 167 | 165 |
| 1065667 | 137 | 127 | 137 | 94 | 115 | 116 | 163 | 134 |
| 1066092 | 133 | 126 | 87 | 75 | 100 | 113 | 104 | 106 |

Example 7

Design and Synthesis of Modified Oligonucleotides Complementary to a Human UBE3A-ATS Nucleic Acid Modified oligonucleotides were synthesized as indicated in the tables below.

The compounds in Table 62 are 4-10-6 MOE gapmers. The gapmers are 20 nucleosides in length, wherein the central gap segment consists of ten 2'-β-D-deoxynucleosides, the 5' wing segment consists of four 2'-MOE nucleosides, and the 3' wing segment consists of six 2'-MOE nucleosides. The sugar motif of the gapmers is (from 5' to 3'): eeeeddddddddddeeeeee; wherein 'd' represents a 2'-β-D-deoxyriboxyl sugar moiety, and 'e' represents a 2'-MOE sugar moiety. The gapmers have an internucleoside linkage motif of (from 5' to 3'): sooosssssssssooss; wherein "s" represents a phosphorothioate internucleoside linkage and "o" represents a phosphodiester internucleoside linkage. All cytosine residues are 5-methylcytosines.

TABLE 62

4-10-6 MOE gapmers with a mixed PO/PS internucleoside linkages complementary to human UBE3A-ATS

| Compound ID | SEQ ID NO: 1 Start Site | SEQ ID NO: 1 Stop Site | SEQUENCE | SEQ ID NO |
|---|---|---|---|---|
| 1263473 | 460996 | 461015 | TTTTTCCATTTTTCTCTTAG | 2745 |
| 1263474 | 460997 | 461016 | GTTTTTCCATTTTTCTCTTA | 2746 |
| 1263475 | 460999 | 461018 | GTGTTTTTCCATTTTTCTCT | 598 |
| 1263476 | 461000 | 461019 | TGTGTTTTTCCATTTTTCTC | 2747 |
| 1263477 | 461001 | 461020 | GTGTGTTTTTCCATTTTTCT | 2748 |
| 1263478 | 461002 | 461021 | TGTGTGTTTTTCCATTTTTC | 2749 |
| 1263479 | 465235 | 465254 | TCATCTCGGGTATATAAATT | 2750 |
| 1263480 | 465236 | 465255 | GTCATCTCGGGTATATAAAT | 1132 |
| 1263481 | 465237 | 465256 | GGTCATCTCGGGTATATAAA | 1207 |
| 1263482 | 465238 | 465257 | TGGTCATCTCGGGTATATAA | 318 |
| 1263483 | 465239 | 465258 | TTGGTCATCTCGGGTATATA | 2473 |
| 1263484 | 465240 | 465259 | ATTGGTCATCTCGGGTATAT | 1655 |
| 1263485 | 465241 | 465260 | TATTGGTCATCTCGGGTATA | 2548 |
| 1263486 | 468985 | 469004 | TCACCATTTTGACCTTCTTA | 2751 |
| 1263487 | 468986 | 469005 | TTCACCATTTTGACCTTCTT | 2752 |
| 1263488 | 468987 | 469006 | CTTCACCATTTTGACCTTCT | 2753 |
| 1263489 | 468988 | 469007 | GCTTCACCATTTTGACCTTC | 377 |
| 1263490 | 468989 | 469008 | TGCTTCACCATTTTGACCTT | 2754 |
| 1263491 | 468990 | 469009 | CTGCTTCACCATTTTGACCT | 2755 |
| 1263492 | 468991 | 469010 | ACTGCTTCACCATTTTGACC | 2756 |
| 1263494 | 464526 | 464545 | TCAGTTAGGTTAGTGCACAG | 2757 |
| 1263495 | 464527 | 464546 | CTCAGTTAGGTTAGTGCACA | 2758 |
| 1263496 | 464528 | 464547 | GCTCAGTTAGGTTAGTGCAC | 1504 |
| 1263497 | 464529 | 464548 | TGCTCAGTTAGGTTAGTGCA | 2759 |
| 1263498 | 464530 | 464549 | CTGCTCAGTTAGGTTAGTGC | 2729 |
| 1263499 | 464531 | 464550 | TCTGCTCAGTTAGGTTAGTG | 2760 |
| 1263500 | 479994 | 480013 | GAGCTATCTGTACAAAATGG | 2761 |
| 1263501 | 479995 | 480014 | TGAGCTATCTGTACAAAATG | 2743 |
| 1263502 | 479996 | 480015 | GTGAGCTATCTGTACAAAAT | 2744 |
| 1263503 | 479997 | 480016 | CGTGAGCTATCTGTACAAAA | 1142 |
| 1263532 | 483970 | 483989 | GCATACCCAGGGTAGGATTC | 765 |
| 1263534 | 483971 | 483990 | TGCATACCCAGGGTAGGATT | 1445 |
| 1263536 | 483972 | 483991 | GTGCATACCCAGGGTAGGAT | 766 |
| 1263539 | 483973 | 483992 | TGTGCATACCCAGGGTAGGA | 2762 |
| 1263541 | 483974 | 483993 | ATGTGCATACCCAGGGTAGG | 2595 |
| 1273009 | 457735 | 457754 | GCCAGGTGTCTTATATCTAT | 2852 |
| 1273010 | 474393 | 474412 | GGTCAACCAATTTGCTATTC | 1809 |
| 1273011 | 474394 | 474413 | AGGTCAACCAATTTGCTATT | 2853 |
| 1273012 | 474396 | 474415 | TTAGGTCAACCAATTTGCTA | 2854 |
| 1273013 | 457736 | 457755 | AGCCAGGTGTCTTATATCTA | 2855 |
| 1273014 | 478535 | 478554 | AACGCAATGTATCAGGCAAC | 2856 |
| 1273015 | 478536 | 478555 | AAACGCAATGTATCAGGCAA | 2857 |
| 1273016 | 478730 | 478749 | GATCACATTACCCATCCGTT | 2858 |
| 1273017 | 478731 | 478750 | TGATCACATTACCCATCCGT | 2859 |
| 1273018 | 478732 | 478751 | CTGATCACATTACCCATCCG | 2860 |
| 1273019 | 474395 | 474414 | TAGGTCAACCAATTTGCTAT | 2861 |
| 1273020 | 478733 | 478752 | GCTGATCACATTACCCATCC | 1291 |
| 1273021 | 478734 | 478753 | TGCTGATCACATTACCCATC | 2862 |
| 1273022 | 478735 | 478754 | TTGCTGATCACATTACCCAT | 2863 |

The compounds in Table 63 are 5-10-5 MOE gapmers. The gapmers are 20 nucleosides in length, wherein the central gap segment consists of ten 2'-β-D-deoxyribonucleosides and the 5' and 3' wing segments each consist of five 2'-MOE nucleosides. The sugar motif for the gapmers is (from 5' to 3'): eeeeedddddddddddeeeee; wherein 'd' represents a 2'-β-D-deoxyribosyl sugar moiety, and 'e' represents a 2'-MOE sugar moiety The gapmers have an internucleoside linkage motif of (from 5' to 3'): soooosssssssssooss, wherein "s" represents a phosphorothioate internucleoside linkage and "o" represents a phosphodiester internucleoside linkage. All cytosine residues are 5-methylcytosines.

TABLE 63

5-10-5 MOE gapmers with a mixed PO/PS internucleoside linkages complementary to human UBE3A-ATS

| Compound ID | SEQ ID NO: 1 Start Site | SEQ ID NO: 1 Stop Site | SEQUENCE | SEQ ID NO |
|---|---|---|---|---|
| 1263451 | 460996 | 461015 | TTTTTCCATTTTTCTCTTAG | 2745 |
| 1263452 | 460997 | 461016 | GTTTTTCCATTTTTCTCTTA | 2746 |
| 1263453 | 461000 | 461019 | TGTGTTTTTCCATTTTTCTC | 2747 |
| 1263454 | 461001 | 461020 | GTGTGTTTTTCCATTTTTCT | 2748 |
| 1263455 | 461002 | 461021 | TGTGTGTTTTTCCATTTTTC | 2749 |
| 1263456 | 465235 | 465254 | TCATCTCGGGTATATAAATT | 2750 |
| 1263460 | 468985 | 469004 | TCACCATTTTGACCTTCTTA | 2751 |
| 1263461 | 468986 | 469005 | TTCACCATTTTGACCTTCTT | 2752 |
| 1263462 | 468987 | 469006 | CTTCACCATTTTGACCTTCT | 2753 |
| 1263463 | 468989 | 469008 | TGCTTCACCATTTTGACCTT | 2754 |
| 1263464 | 468990 | 469009 | CTGCTTCACCATTTTGACCT | 2755 |
| 1263465 | 468991 | 469010 | ACTGCTTCACCATTTTGACC | 2756 |
| 1263466 | 464526 | 464545 | TCAGTTAGGTTAGTGCACAG | 2757 |
| 1263467 | 464527 | 464546 | CTCAGTTAGGTTAGTGCACA | 2758 |
| 1263468 | 464529 | 464548 | TGCTCAGTTAGGTTAGTGCA | 2759 |
| 1263469 | 464531 | 464550 | TCTGCTCAGTTAGGTTAGTG | 2760 |
| 1263470 | 479994 | 480013 | GAGCTATCTGTACAAAATGG | 2761 |
| 1263471 | 479995 | 480014 | TGAGCTATCTGTACAAAATG | 2743 |
| 1263472 | 479996 | 480015 | GTGAGCTATCTGTACAAAAT | 2744 |
| 1263538 | 483973 | 483992 | TGTGCATACCCAGGGTAGGA | 2762 |
| 1272943 | 467048 | 467067 | TTTCATCAGTTAGTCAGGTT | 2786 |
| 1272944 | 465605 | 465624 | CCTTTCTATTTCAGACCGAA | 2787 |
| 1272945 | 465607 | 465626 | TGCCTTTCTATTTCAGACCG | 2788 |
| 1272946 | 465608 | 465627 | GTGCCTTTCTATTTCAGACC | 2789 |
| 1272947 | 465609 | 465628 | AGTGCCTTTCTATTTCAGAC | 2790 |
| 1272948 | 468919 | 468938 | AGTATAGATGCCTCTCCTCT | 2791 |
| 1272949 | 468920 | 468939 | AAGTATAGATGCCTCTCCTC | 2792 |
| 1272950 | 468921 | 468940 | TAAGTATAGATGCCTCTCCT | 2793 |
| 1272951 | 474796 | 474815 | ATTGACACCTCCAACTGTAA | 2794 |
| 1272952 | 474798 | 474817 | GTATTGACACCTCCAACTGT | 2795 |
| 1272953 | 474800 | 474819 | TGGTATTGACACCTCCAACT | 2796 |
| 1272954 | 474801 | 474820 | TTGGTATTGACACCTCCAAC | 2797 |
| 1272955 | 474802 | 474821 | TTTGGTATTGACACCTCCAA | 2798 |
| 1272956 | 476012 | 476031 | GTTTTCGCCCGTTACCTCAA | 2799 |
| 1272957 | 476013 | 476032 | AGTTTTCGCCCGTTACCTCA | 2800 |
| 1272958 | 476014 | 476033 | CAGTTTTCGCCCGTTACCTC | 2801 |
| 1272959 | 476017 | 476036 | CTCCAGTTTTCGCCCGTTAC | 2802 |
| 1272960 | 467052 | 467071 | ACACTTTCATCAGTTAGTCA | 2803 |
| 1272961 | 476018 | 476037 | TCTCCAGTTTTCGCCCGTTA | 2804 |
| 1272962 | 478437 | 478456 | GCTATAGGTGTCACATATTC | 2805 |
| 1272963 | 478442 | 478461 | TTGTAGCTATAGGTGTCACA | 2806 |
| 1272964 | 478443 | 478462 | TTTGTAGCTATAGGTGTCAC | 2807 |
| 1272965 | 483106 | 483125 | GCAATGGACTTAGTACACAA | 2808 |
| 1272966 | 483107 | 483126 | GGCAATGGACTTAGTACACA | 2809 |
| 1272967 | 483110 | 483129 | TTAGGCAATGGACTTAGTAC | 2810 |
| 1272968 | 483111 | 483130 | CTTAGGCAATGGACTTAGTA | 2811 |
| 1272969 | 485766 | 485785 | CAGATTCCTAAATACGCACA | 2812 |
| 1272970 | 485767 | 485786 | TCAGATTCCTAAATACGCAC | 2813 |
| 1272971 | 485768 | 485787 | GTCAGATTCCTAAATACGCA | 2814 |
| 1272972 | 485771 | 485790 | GTGGTCAGATTCCTAAATAC | 2815 |
| 1272973 | 487601 | 487620 | AGTGTCATATGTAGCAATTA | 2816 |
| 1272974 | 487603 | 487622 | TTAGTGTCATATGTAGCAAT | 2817 |
| 1272975 | 501337 | 501356 | TATGTAGCTCAGCTCAATGT | 2818 |
| 1272976 | 501339 | 501358 | CTTATGTAGCTCAGCTCAAT | 2819 |
| 1272977 | 501342 | 501361 | CTGCTTATGTAGCTCAGCTC | 2820 |
| 1272978 | 468734 | 468753 | AAAATCCATTTGTCCAGTCT | 2821 |
| 1272979 | 505552 | 505571 | TTTGCTTTTCAGTCAGGTAC | 2822 |
| 1272980 | 468735 | 468754 | TAAAATCCATTTGTCCAGTC | 2823 |
| 1272981 | 468736 | 468755 | CTAAAATCCATTTGTCCAGT | 2824 |
| 1272982 | 506110 | 506129 | GCATTGGCTTCATATTTCTC | 2825 |
| 1272983 | 506112 | 506131 | GAGCATTGGCTTCATATTTC | 2826 |
| 1272984 | 508942 | 508961 | CATTATTCTCTAGTGCCTAT | 2827 |
| 1272985 | 508943 | 508962 | TCATTATTCTCTAGTGCCTA | 2828 |
| 1272986 | 508947 | 508966 | GTCTTCATTATTCTCTAGTG | 2829 |
| 1272987 | 508948 | 508967 | AGTCTTCATTATTCTCTAGT | 2830 |
| 1272988 | 458439 | 458458 | AACTTCATCAATATTTCCCC | 2831 |
| 1272989 | 458397 | 458416 | TGTGGGCCTCTATTAAGATC | 2832 |
| 1272990 | 458399 | 458418 | CATGTGGGCCTCTATTAAGA | 2833 |
| 1272991 | 458401 | 458420 | TGCATGTGGGCCTCTATTAA | 2834 |
| 1272992 | 458453 | 458472 | TTTATACTTTACCCAACTTC | 2835 |
| 1272993 | 458454 | 458473 | CTTTATACTTTACCCAACTT | 2836 |

TABLE 63-continued 5-10-5 MOE gapmers with a mixed PO/PS internucleoside linkages complementary to human UBE3A-ATS

| Compound ID | SEQ ID NO: 1 Start Site | SEQ ID NO: 1 Stop Site | SEQUENCE | SEQ ID NO |
|---|---|---|---|---|
| 1272994 | 458455 | 458474 | GCTTTATACTTTACCCAACT | 2837 |
| 1272995 | 458440 | 458459 | CAACTTCATCAATATTTCCC | 2838 |
| 1272996 | 458457 | 458476 | TGGCTTTATACTTTACCCAA | 2839 |
| 1272997 | 458458 | 458477 | TTGGCTTTATACTTTACCCA | 2840 |
| 1272998 | 458459 | 458478 | TTTGGCTTTATACTTTACCC | 2841 |
| 1272999 | 458569 | 458588 | CTTTAGTATGTCGAGAACTC | 2842 |
| 1273000 | 458441 | 458460 | CCAACTTCATCAATATTTCC | 2843 |
| 1273001 | 461466 | 461485 | ACTCATCATGATCTTGGTAA | 2844 |
| 1273002 | 463053 | 463072 | TCACTGAGTTTTTGTAGTTC | 2845 |
| 1273003 | 463191 | 463210 | TCTGGAATCTTGTAGAGGAT | 2846 |
| 1273004 | 463192 | 463211 | TTCTGGAATCTTGTAGAGGA | 2847 |
| 1273005 | 467047 | 467066 | TTCATCAGTTAGTCAGGTTA | 2848 |
| 1273006 | 464395 | 464414 | ATTCAGCACTTAGGTAGTTC | 2849 |
| 1273007 | 464399 | 464418 | TCCCATTCAGCACTTAGGTA | 2850 |
| 1273008 | 464400 | 464419 | TTCCCATTCAGCACTTAGGT | 2851 |
| 1273061 | 468982 | 469001 | CCATTTTGACCTTCTTAGCC | 2872 |
| 1273062 | 468983 | 469002 | ACCATTTTGACCTTCTTAGC | 2873 |
| 1273063 | 465232 | 465251 | TCTCGGGTATATAAATTAAT | 2874 |
| 1273064 | 465233 | 465252 | ATCTCGGGTATATAAATTAA | 2875 |
| 1273065 | 468992 | 469011 | AACTGCTTCACCATTTTGAC | 2876 |
| 1273066 | 468993 | 469012 | TAACTGCTTCACCATTTTGA | 2877 |
| 1273067 | 468994 | 469013 | TTAACTGCTTCACCATTTTG | 2878 |
| 1273068 | 464522 | 464541 | TTAGGTTAGTGCACAGATAA | 2879 |
| 1273069 | 464523 | 464542 | GTTAGGTTAGTGCACAGATA | 2880 |
| 1273070 | 464534 | 464553 | GTCTCTGCTCAGTTAGGTTA | 2881 |
| 1273071 | 479991 | 480010 | CTATCTGTACAAAATGGAAC | 2882 |
| 1273072 | 479992 | 480011 | GCTATCTGTACAAAATGGAA | 2883 |
| 1273073 | 479993 | 480012 | AGCTATCTGTACAAAATGGA | 2884 |
| 1273084 | 457732 | 457751 | AGGTGTCTTATATCTATGAT | 2885 |
| 1273085 | 457742 | 457761 | GAAACCAGCCAGGTGTCTTA | 2886 |
| 1273086 | 474391 | 474410 | TCAACCAATTTGCTATTCAT | 2887 |
| 1273087 | 474392 | 474411 | GTCAACCAATTTGCTATTCA | 2888 |
| 1273088 | 457733 | 457752 | CAGGTGTCTTATATCTATGA | 2889 |
| 1273089 | 474394 | 474413 | AGGTCAACCAATTTGCTATT | 2853 |
| 1273090 | 474395 | 474414 | TAGGTCAACCAATTTGCTAT | 2861 |
| 1273091 | 474396 | 474415 | TTAGGTCAACCAATTTGCTA | 2854 |
| 1273092 | 474397 | 474416 | TTTAGGTCAACCAATTTGCT | 2890 |
| 1273093 | 474398 | 474417 | GTTTAGGTCAACCAATTTGC | 2891 |
| 1273094 | 474399 | 474418 | GGTTTAGGTCAACCAATTTG | 2892 |
| 1273095 | 478527 | 478546 | GTATCAGGCAACAGAATCTC | 2893 |
| 1273096 | 478528 | 478547 | TGTATCAGGCAACAGAATCT | 2894 |
| 1273097 | 478529 | 478548 | ATGTATCAGGCAACAGAATC | 2895 |
| 1273098 | 457734 | 457753 | CCAGGTGTCTTATATCTATG | 2896 |
| 1273099 | 478535 | 478554 | AACGCAATGTATCAGGCAAC | 2856 |
| 1273101 | 478537 | 478556 | AAAACGCAATGTATCAGGCA | 2897 |
| 1273102 | 478538 | 478557 | TAAAACGCAATGTATCAGGC | 2898 |
| 1273103 | 457735 | 457754 | GCCAGGTGTCTTATATCTAT | 2852 |
| 1273104 | 478727 | 478746 | CACATTACCCATCCGTTCTT | 2899 |
| 1273105 | 478728 | 478747 | TCACATTACCCATCCGTTCT | 2900 |
| 1273106 | 478729 | 478748 | ATCACATTACCCATCCGTTC | 2901 |
| 1273107 | 478730 | 478749 | GATCACATTACCCATCCGTT | 2858 |
| 1273108 | 478731 | 478750 | TGATCACATTACCCATCCGT | 2859 |
| 1273109 | 478732 | 478751 | CTGATCACATTACCCATCCG | 2860 |
| 1273110 | 478734 | 478753 | TGCTGATCACATTACCCATC | 2862 |
| 1273111 | 478735 | 478754 | TTGCTGATCACATTACCCAT | 2863 |
| 1273112 | 457736 | 457755 | AGCCAGGTGTCTTATATCTA | 2855 |
| 1273113 | 478737 | 478756 | TCTTGCTGATCACATTACCC | 2902 |
| 1273114 | 478738 | 478757 | TTCTTGCTGATCACATTACC | 2903 |
| 1273115 | 457737 | 457756 | CAGCCAGGTGTCTTATATCT | 2904 |

The compounds in Table 64 are 6-10-4 MOE gapmers. The gapmers are 20 nucleosides in length, wherein the central gap segment consists of ten 2'-β-D-deoxynucleosides, the 5' wing segment consists of six 2'-MOE nucleosides, and the 3' wing segment consists of four 2'-MOE nucleosides. The sugar motif of the gapmers is (from 5' to 3'): eeeeeedddddddddeeee; wherein 'd' represents a 2'-β-D-deoxyriboxyl sugar moiety, and 'e' represents a 2'-MOE sugar moiety. The gapmers have an internucleoside linkage motif of (from 5' to 3'): sooooossssssssssoss, wherein "s" represents a phosphorothioate internucleoside linkage and "o" represents a phosphodiester internucleoside linkage. All cytosine residues are 5-methylcytosines.

TABLE 64

6-10-4 MOE gapmers with a mixed PO/PS internucleoside linkages complementary to human UBE3A-ATS

| Compound ID | SEQ ID NO: 1 Start Site | SEQ ID NO: 1 Stop Site | SEQUENCE | SEQ ID NO |
|---|---|---|---|---|
| 1263457 | 479995 | 480014 | TGAGCTATCTGTACAAAATG | 2743 |
| 1263458 | 479996 | 480015 | GTGAGCTATCTGTACAAAAT | 2744 |
| 1263459 | 479997 | 480016 | CGTGAGCTATCTGTACAAAA | 1142 |
| 1263504 | 460996 | 461015 | TTTTTCCATTTTTCTCTTAG | 2745 |
| 1263505 | 460997 | 461016 | GTTTTTCCATTTTTCTCTTA | 2746 |
| 1263506 | 460999 | 461018 | GTGTTTTCCATTTTTCTCT | 598 |
| 1263507 | 461000 | 461019 | TGTGTTTTCCATTTTTCTC | 2747 |
| 1263508 | 461001 | 461020 | GTGTGTTTTCCATTTTTCT | 2748 |
| 1263509 | 461002 | 461021 | TGTGTGTTTTCCATTTTTC | 2749 |
| 1263510 | 465235 | 465254 | TCATCTCGGGTATATAAATT | 2750 |
| 1263511 | 465236 | 465255 | GTCATCTCGGGTATATAAAT | 1132 |
| 1263512 | 465237 | 465256 | GGTCATCTCGGGTATATAAA | 1207 |
| 1263513 | 465238 | 465257 | TGGTCATCTCGGGTATATAA | 318 |
| 1263514 | 465239 | 465258 | TTGGTCATCTCGGGTATATA | 2473 |
| 1263515 | 465240 | 465259 | ATTGGTCATCTCGGGTATAT | 1655 |
| 1263516 | 465241 | 465260 | TATTGGTCATCTCGGGTATA | 2548 |
| 1263517 | 468985 | 469004 | TCACCATTTTGACCTTCTTA | 2751 |
| 1263518 | 468986 | 469005 | TTCACCATTTTGACCTTCTT | 2752 |
| 1263519 | 468987 | 469006 | CTTCACCATTTTGACCTTCT | 2753 |
| 1263520 | 468988 | 469007 | GCTTCACCATTTTGACCTTC | 377 |
| 1263521 | 468989 | 469008 | TGCTTCACCATTTTGACCTT | 2754 |
| 1263522 | 468990 | 469009 | CTGCTTCACCATTTTGACCT | 2755 |
| 1263523 | 468991 | 469010 | ACTGCTTCACCATTTTGACC | 2756 |
| 1263524 | 464525 | 464544 | CAGTTAGGTTAGTGCACAGA | 2728 |
| 1263525 | 464526 | 464545 | TCAGTTAGGTTAGTGCACAG | 2757 |
| 1263526 | 464527 | 464546 | CTCAGTTAGGTTAGTGCACA | 2758 |
| 1263527 | 464528 | 464547 | GCTCAGTTAGGTTAGTGCAC | 1504 |
| 1263528 | 464529 | 464548 | TGCTCAGTTAGGTTAGTGCA | 2759 |
| 1263529 | 464530 | 464549 | CTGCTCAGTTAGGTTAGTGC | 2729 |
| 1263530 | 464531 | 464550 | TCTGCTCAGTTAGGTTAGTG | 2760 |
| 1263531 | 479994 | 480013 | GAGCTATCTGTACAAAATGG | 2761 |
| 1263533 | 483970 | 483989 | GCATACCCAGGGTAGGATTC | 765 |
| 1263535 | 483971 | 483990 | TGCATACCCAGGGTAGGATT | 1445 |
| 1263537 | 483972 | 483991 | GTGCATACCCAGGGTAGGAT | 766 |
| 1263540 | 483973 | 483992 | TGTGCATACCCAGGGTAGGA | 2762 |
| 1263542 | 483974 | 483993 | ATGTGCATACCCAGGGTAGG | 2595 |
| 1273023 | 457735 | 457754 | GCCAGGTGTCTTATATCTAT | 2852 |
| 1273024 | 457736 | 457755 | AGCCAGGTGTCTTATATCTA | 2855 |
| 1273025 | 474393 | 474412 | GGTCAACCAATTTGCTATTC | 1809 |
| 1273026 | 474394 | 474413 | AGGTCAACCAATTTGCTATT | 2853 |
| 1273027 | 474395 | 474414 | TAGGTCAACCAATTTGCTAT | 2861 |
| 1273028 | 474396 | 474415 | TTAGGTCAACCAATTTGCTA | 2854 |
| 1273029 | 478535 | 478554 | AACGCAATGTATCAGGCAAC | 2856 |
| 1273030 | 478536 | 478555 | AAACGCAATGTATCAGGCAA | 2857 |
| 1273031 | 478730 | 478749 | GATCACATTACCCATCCGTT | 2858 |
| 1273032 | 478731 | 478750 | TGATCACATTACCCATCCGT | 2859 |
| 1273033 | 478732 | 478751 | CTGATCACATTACCCATCCG | 2860 |
| 1273034 | 478733 | 478752 | GCTGATCACATTACCCATCC | 1291 |
| 1273035 | 478734 | 478753 | TGCTGATCACATTACCCATC | 2862 |
| 1273036 | 478735 | 478754 | TTGCTGATCACATTACCCAT | 2863 |

The compounds in Table 65 are 4-8-6 MOE gapmers. The gapmers are 18 nucleosides in length, wherein the central gap segment consists of eight 2'-β-D-deoxynucleosides, the 5' segment consists of four 2'-MOE nucleosides, and the 3' wing segment consists of six 2'-MOE nucleosides. The sugar motif of the gapmers is (from 5' to 3'): eeeedddddddeeeeee; wherein 'd' represents a 2'-β-D-deoxyriboxyl sugar moiety, and 'e' represents a 2'-MOE sugar moiety. The gapmers have an internucleoside linkage motif of (from 5' to 3'): soosssssssssoooss; wherein "s" represents a phosphorothioate internucleoside linkage and "o" represents a phosphodiester internucleoside linkage. All cytosine residues are 5-methylcytosines.

TABLE 65

4-8-6 MOE gapmers with a mixed PO/PS internucleoside linkages complementary to human UBE3A-ATS

| Compound ID | SEQ ID NO: 1 Start Site | SEQ ID NO: 1 Stop Site | SEQUENCE | SEQ ID NO |
|---|---|---|---|---|
| 1263403 | 465237 | 465254 | TCATCTCGGGTATATAAA | 2768 |
| 1263404 | 465238 | 465255 | GTCATCTCGGGTATATAA | 2769 |
| 1263405 | 465239 | 465256 | GGTCATCTCGGGTATATA | 2770 |
| 1263406 | 465240 | 465257 | TGGTCATCTCGGGTATAT | 2771 |
| 1263407 | 465241 | 465258 | TTGGTCATCTCGGGTATA | 2772 |
| 1263408 | 468987 | 469004 | TCACCATTTTGACCTTCT | 2773 |

TABLE 65-continued 4-8-6 MOE gapmers with a mixed PO/PS internucleoside linkages complementary to human UBE3A-ATS

| Compound ID | SEQ ID NO: 1 Start Site | SEQ ID NO: 1 Stop Site | SEQUENCE | SEQ ID NO |
|---|---|---|---|---|
| 1263409 | 468988 | 469005 | TTCACCATTTTGACCTTC | 2774 |
| 1263410 | 468989 | 469006 | CTTCACCATTTTGACCTT | 2775 |
| 1263411 | 468991 | 469008 | TGCTTCACCATTTTGACC | 2776 |
| 1263412 | 464527 | 464544 | CAGTTAGGTTAGTGCACA | 2777 |
| 1263413 | 464528 | 464545 | TCAGTTAGGTTAGTGCAC | 2778 |
| 1263414 | 464529 | 464546 | CTCAGTTAGGTTAGTGCA | 2779 |
| 1263415 | 464530 | 464547 | GCTCAGTTAGGTTAGTGC | 2780 |
| 1263416 | 464531 | 464548 | TGCTCAGTTAGGTTAGTG | 2781 |
| 1263417 | 479996 | 480013 | GAGCTATCTGTACAAAAT | 2782 |
| 1263418 | 479997 | 480014 | TGAGCTATCTGTACAAAA | 2783 |
| 1263419 | 479998 | 480015 | GTGAGCTATCTGTACAAA | 2784 |
| 1263420 | 479999 | 480016 | CGTGAGCTATCTGTACAA | 2785 |
| 1263543 | 483971 | 483988 | CATACCCAGGGTAGGATT | 2763 |
| 1263546 | 483972 | 483989 | GCATACCCAGGGTAGGAT | 2764 |
| 1263549 | 483973 | 483990 | TGCATACCCAGGGTAGGA | 2765 |
| 1263552 | 483974 | 483991 | GTGCATACCCAGGGTAGG | 2766 |
| 1263557 | 483975 | 483992 | TGTGCATACCCAGGGTAG | 2767 |
| 1273037 | 457737 | 457754 | GCCAGGTGTCTTATATCT | 2864 |
| 1273038 | 478535 | 478552 | CGCAATGTATCAGGCAAC | 2865 |
| 1273039 | 478536 | 478553 | ACGCAATGTATCAGGCAA | 2866 |
| 1273040 | 478732 | 478749 | GATCACATTACCCATCCG | 2867 |
| 1273041 | 478733 | 478750 | TGATCACATTACCCATCC | 2868 |
| 1273042 | 478735 | 478752 | GCTGATCACATTACCCAT | 2869 |
| 1273043 | 457738 | 457755 | AGCCAGGTGTCTTATATC | 2870 |
| 1273060 | 474393 | 474410 | TCAACCAATTTGCTATTC | 2871 |

TABLE 66

5-8-5 MOE gapmers with a mixed PO/PS internucleoside linkages complementary to human UBE3A-ATS

| Compound ID | SEQ ID NO: 1 Start Site | SEQ ID NO: 1 Stop Site | SEQUENCE | SEQ ID NO |
|---|---|---|---|---|
| 1263421 | 465237 | 465254 | TCATCTCGGGTATATAAA | 2768 |
| 1263422 | 465238 | 465255 | GTCATCTCGGGTATATAA | 2769 |
| 1263423 | 465239 | 465256 | GGTCATCTCGGGTATATA | 2770 |
| 1263424 | 465240 | 465257 | TGGTCATCTCGGGTATAT | 2771 |
| 1263425 | 465241 | 465258 | TTGGTCATCTCGGGTATA | 2772 |
| 1263426 | 468987 | 469004 | TCACCATTTTGACCTTCT | 2773 |
| 1263427 | 464527 | 464544 | CAGTTAGGTTAGTGCACA | 2777 |
| 1263428 | 464528 | 464545 | TCAGTTAGGTTAGTGCAC | 2778 |
| 1263429 | 464529 | 464546 | CTCAGTTAGGTTAGTGCA | 2779 |
| 1263430 | 464530 | 464547 | GCTCAGTTAGGTTAGTGC | 2780 |
| 1263431 | 464531 | 464548 | TGCTCAGTTAGGTTAGTG | 2781 |
| 1263432 | 479996 | 480013 | GAGCTATCTGTACAAAAT | 2782 |
| 1263433 | 479997 | 480014 | TGAGCTATCTGTACAAAA | 2783 |
| 1263434 | 479998 | 480015 | GTGAGCTATCTGTACAAA | 2784 |
| 1263435 | 479999 | 480016 | CGTGAGCTATCTGTACAA | 2785 |
| 1263544 | 483971 | 483988 | CATACCCAGGGTAGGATT | 2763 |
| 1263547 | 483972 | 483989 | GCATACCCAGGGTAGGAT | 2764 |
| 1263550 | 483973 | 483990 | TGCATACCCAGGGTAGGA | 2765 |
| 1263553 | 483974 | 483991 | GTGCATACCCAGGGTAGG | 2766 |
| 1263554 | 483975 | 483992 | TGTGCATACCCAGGGTAG | 2767 |
| 1273052 | 457737 | 457754 | GCCAGGTGTCTTATATCT | 2864 |
| 1273053 | 457738 | 457755 | AGCCAGGTGTCTTATATC | 2870 |
| 1273054 | 474393 | 474410 | TCAACCAATTTGCTATTC | 2871 |
| 1273055 | 478535 | 478552 | CGCAATGTATCAGGCAAC | 2865 |
| 1273056 | 478536 | 478553 | ACGCAATGTATCAGGCAA | 2866 |
| 1273057 | 478732 | 478749 | GATCACATTACCCATCCG | 2867 |
| 1273058 | 478733 | 478750 | TGATCACATTACCCATCC | 2868 |
| 1273059 | 478735 | 478752 | GCTGATCACATTACCCAT | 2869 |

The compounds in Table 66 are 5-8-5 MOE gapmers. The gapmers are 18 nucleosides in length, wherein the central gap segment consists of eight 2'-β-D-deoxynucleosides and the 5' and 3' wing segments each consists of five 2'-MOE nucleosides. The sugar motif of the gapmers is (from 5' to 3'): eeeeedddddddeeeee; wherein 'd' represents a 2'-β-D-deoxyriboxyl sugar moiety, and 'e' represents a 2'-MOE sugar moiety. The gapmers have an internucleoside linkage motif of (from 5' to 3'): sooosssssssssooss; wherein "s" represents a phosphorothioate internucleoside linkage and "o" represents a phosphodiester internucleoside linkage. All cytosine residues are 5-methylcytosines.

The compounds in Table 67 are 6-8-4 MOE gapmers. The gapmers are 18 nucleosides in length, wherein the central gap segment consists of eight 2'-β-D-deoxynucleosides, the 5' wing segment consists of six 2'-MOE nucleosides, and the 3' wing segment consists of four 2'-MOE nucleosides. The sugar motif of the gapmers is (from 5' to 3'): eeeeeedddddddeeee; wherein 'd' represents a 2'-β-D-deoxyriboxyl sugar moiety, and 'e' represents a 2'-MOE sugar moiety. The gapmers have an internucleoside linkage motif of (from 5' to 3'): soooosssssssssoss; wherein "s" represents a phosphorothioate internucleoside linkage and "o" represents a phosphodiester internucleoside linkage. All cytosine residues are 5-methylcytosines.

TABLE 67

6-8-4 MOE gapmers with a mixed PO/PS internucleoside linkages complementary to human UBE3A-ATS

| Compound ID | SEQ ID NO: 1 Start Site | SEQ ID NO: 1 Stop Site | SEQUENCE | SEQ ID NO |
|---|---|---|---|---|
| 1263436 | 465237 | 465254 | TCATCTCGGGTATATAAA | 2768 |
| 1263437 | 465238 | 465255 | GTCATCTCGGGTATATAA | 2769 |
| 1263438 | 465239 | 465256 | GGTCATCTCGGGTATATA | 2770 |
| 1263439 | 465240 | 465257 | TGGTCATCTCGGGTATAT | 2771 |
| 1263440 | 465241 | 465258 | TTGGTCATCTCGGGTATA | 2772 |
| 1263441 | 468987 | 469004 | TCACCATTTTGACCTTCT | 2773 |
| 1263442 | 464527 | 464544 | CAGTTAGGTTAGTGCACA | 2777 |
| 1263443 | 464528 | 464545 | TCAGTTAGGTTAGTGCAC | 2778 |
| 1263444 | 464529 | 464546 | CTCAGTTAGGTTAGTGCA | 2779 |
| 1263445 | 464530 | 464547 | GCTCAGTTAGGTTAGTGC | 2780 |
| 1263446 | 464531 | 464548 | TGCTCAGTTAGGTTAGTG | 2781 |
| 1263447 | 479996 | 480013 | GAGCTATCTGTACAAAAT | 2782 |
| 1263448 | 479997 | 480014 | TGAGCTATCTGTACAAAA | 2783 |
| 1263449 | 479998 | 480015 | GTGAGCTATCTGTACAAA | 2784 |
| 1263450 | 479999 | 480016 | CGTGAGCTATCTGTACAA | 2785 |
| 1263545 | 483971 | 483988 | CATACCCAGGGTAGGATT | 2763 |
| 1263548 | 483972 | 483989 | GCATACCCAGGGTAGGAT | 2764 |
| 1263551 | 483973 | 483990 | TGCATACCCAGGGTAGGA | 2765 |
| 1263555 | 483974 | 483991 | GTGCATACCCAGGGTAGG | 2766 |
| 1263556 | 483975 | 483992 | TGTGCATACCCAGGGTAG | 2767 |
| 1273044 | 457737 | 457754 | GCCAGGTGTCTTATATCT | 2864 |
| 1273045 | 457738 | 457755 | AGCCAGGTGTCTTATATC | 2870 |
| 1273046 | 474393 | 474410 | TCAACCAATTTGCTATTC | 2871 |
| 1273047 | 478535 | 478552 | CGCAATGTATCAGGCAAC | 2865 |
| 1273048 | 478536 | 478553 | ACGCAATGTATCAGGCAA | 2866 |
| 1273049 | 478732 | 478749 | GATCACATTACCCATCCG | 2867 |
| 1273050 | 478733 | 478750 | TGATCACATTACCCATCC | 2868 |
| 1273051 | 478735 | 478752 | GCTGATCACATTACCCAT | 2869 |

Example 8

Effect of Modified Oligonucleotides on Human UBE3A-ATS RNA In Vitro, Multiple Doses Modified oligonucleotides selected from the examples above were tested at various doses in human IPS derived iCell GABANeurons (Cellular Dynamics), as described in Example 4. Reduction of UBE3A-ATS RNA is presented in the tables below as percent UBE3A-ATS RNA amount relative to untreated control (UTC) cells. Where possible, the half maximal inhibitory concentration ($IC_{50}$) of each modified oligonucleotide was calculated using a linear regression on a log/linear plot of the data in excel. In some cases, an $IC_{50}$ could not be reliably calculated and the data point is marked as "N.C.". Values marked with "N.D." indicate that a value was not determined in this experiment.

TABLE 68

Dose-dependent percent reduction of human UBE3A-ATS RNA in vitro (40,000 cells/well)

| | UBE3A-ATS expression (% UTC) | | | | | |
|---|---|---|---|---|---|---|
| Compound Number | 250 nM | 740.7 nM | 2,222 nM | 6,666 nM | 20,000 nM | $IC_{50}$ (µM) |
| 750519 | 69 | 53 | 23 | N.D. | N.D. | 0.7 |
| 617557 | 66 | 54 | 34 | 25 | N.D. | 0.9 |
| 749860 | 62 | 48 | 39 | 20 | 13 | 0.7 |
| 1065593 | 44 | 32 | 21 | 11 | 9 | N.C. |
| 1263517 | 55 | 47 | 35 | 17 | 18 | 0.4 |
| 1263519 | 52 | 39 | 25 | 17 | 16 | 0.2 |
| 1263533 | 51 | 34 | 29 | 28 | 23 | 0.1 |
| 1263540 | 39 | 29 | 29 | 29 | 24 | N.C. |
| 1272994 | 51 | 39 | 28 | 14 | 10 | 0.2 |
| 1272996 | 62 | 45 | 38 | 20 | 13 | 0.6 |
| 1272997 | 73 | 53 | 39 | 24 | 18 | 1.1 |
| 1272998 | 67 | 53 | 30 | 19 | 13 | 0.8 |
| 1273030 | 68 | 54 | 33 | 30 | 22 | 1.0 |
| 1273033 | 51 | 50 | 31 | 32 | 20 | 0.4 |
| 1273049 | 57 | 41 | 32 | 24 | 21 | 0.3 |

TABLE 69

Dose-dependent percent reduction of human UBE3A-ATS RNA in vitro (40,000 cells/well)

| | UBE3A-ATS expression (% UTC) | | | | | |
|---|---|---|---|---|---|---|
| Compound Number | 250 nM | 740.7 nM | 2,222 nM | 6,666 nM | 20,000 nM | $IC_{50}$ (µM) |
| 750519 | 79 | 66 | 29 | 15 | N.D. | 1.1 |
| 1263426 | 64 | 48 | 34 | 29 | 25 | 0.7 |
| 1273042 | 92 | 72 | 58 | 43 | 40 | 5.5 |
| 1273051 | 70 | 47 | 34 | 29 | 22 | 0.9 |
| 1273055 | 71 | 58 | 47 | 40 | 27 | 1.9 |
| 1273057 | 73 | 71 | 50 | 37 | 39 | 3.4 |
| 1273058 | 80 | 69 | 58 | 48 | 34 | 4.8 |
| 1273087 | 55 | 34 | 26 | 14 | 20 | 0.2 |
| 1273107 | 63 | 59 | 36 | 26 | 26 | 1.0 |
| 1273113 | 75 | 68 | 58 | 47 | 28 | 3.6 |

TABLE 70

Dose-dependent percent reduction of human UBE3A-ATS RNA in vitro (40,000 cells/well)

| | UBE3A-ATS expression (% UTC) | | | | | |
|---|---|---|---|---|---|---|
| Compound Number | 250 nM | 740.7 nM | 2,222 nM | 6,666 nM | 20,000 nM | $IC_{50}$ (µM) |
| 750519 | 56 | 38 | 22 | 10 | 25 | 0.2 |
| 749860 | 68 | 47 | 37 | 19 | 16 | 0.8 |
| 1065645 | 66 | 45 | 31 | 19 | 12 | 0.6 |
| 1263461 | 70 | 66 | 55 | 32 | 27 | 2.3 |
| 1263486 | 74 | 48 | 44 | 25 | 21 | 1.2 |

TABLE 71

Dose-dependent percent reduction of human UBE3A-ATS RNA in vitro (40,000 cells/well)

| Compound Number | UBE3A-ATS expression (% UTC) | | | | | $IC_{50}$ (μM) |
|---|---|---|---|---|---|---|
| | 250 nM | 740.7 nM | 2,222 nM | 6,666 nM | 20,000 nM | |
| 750519 | 63 | 39 | 19 | 9 | 4 | 0.4 |
| 1263517 | 56 | 40 | 27 | 17 | 11 | 0.3 |
| 1263518 | 72 | 65 | 42 | 28 | 20 | 1.6 |
| 1263532 | 57 | 44 | 38 | 33 | 64 | 0.5 |
| 1263533 | 41 | 56 | 37 | ND | 26 | NC |

TABLE 72

Dose-dependent percent reduction of human UBE3A-ATS RNA in vitro (40,000 cells/well)

| Compound Number | UBE3A-ATS expression (% UTC) | | | | | $IC_{50}$ (μM) |
|---|---|---|---|---|---|---|
| | 250 nM | 740.7 nM | 2,222 nM | 6,666 nM | 20,000 nM | |
| 617557 | 59 | 56 | 37 | 23 | 23 | 0.8 |
| 1263537 | 70 | 86 | 82 | 77 | 59 | N.C. |
| 1272944 | 51 | 39 | 23 | 13 | 8 | 0.2 |
| 1273033 | 55 | 40 | 32 | 21 | 15 | 0.3 |
| 1273039 | 68 | 58 | 37 | 28 | 20 | 1.1 |

TABLE 73

Dose-dependent percent reduction of human UBE3A-ATS RNA in vitro (40,000 cells/well)

| Compound Number | UBE3A-ATS expression (% UTC) | | | | | $IC_{50}$ (μM) |
|---|---|---|---|---|---|---|
| | 250 nM | 740.7 nM | 2,222 nM | 6,666 nM | 20,000 nM | |
| 617557 | 70 | 57 | 38 | N.D. | N.D. | 1.0 |
| 1273050 | 81 | 75 | 76 | 62 | 41 | 16.5 |
| 1273055 | 59 | 48 | 40 | 26 | 18 | 0.6 |
| 1273062 | 54 | 37 | 28 | 18 | 13 | 0.2 |
| 1273090 | 76 | 64 | 71 | 56 | 55 | N.C. |
| 1273091 | 75 | 79 | 56 | 44 | 32 | 4.3 |

Example 9

Effect of Modified Oligonucleotides on Human UBE3A-ATS RNA and UBE3A RNA In Vitro, Multiple Doses Modified oligonucleotides selected from the examples above were tested at various doses in 10-week differentiated human neuronal cells derived from Angelman Syndrome patient derived IPS cells as described in Example 6 above. Reduction of UBE3A-ATS RNA or induction of UBE3A RNA is presented in the tables below as percent UBE3A-ATS RNA amount or percent UBE3A RNA relative to untreated control (UTC) cells. Values marked with "N.D." indicate that a value was not determined in this experiment.

Several modified oligonucleotides were found to reduce UBE3A-ATS RNA accompanied by concurrent increase in UBE3A RNA in Angelman's patient IPS cell derived neurons.

TABLE 74

Reduction of UBE3A-ATS RNA and increase of UBE3A RNA in Angelman Syndrome IPS cell derived neurons

| Compound ID | UBE3A-ATS RNA (% UTC) (RTS4796) | | | | | UBE3A RNA (% UTC) (RTS35984) | | | | |
|---|---|---|---|---|---|---|---|---|---|---|
| | 250 nM | 741 nM | 2222 nM | 6667 nM | 20000 nM | 250 nM | 741 nM | 2222 nM | 6667 nM | 20000 nM |
| 750519 | 51 | 20 | 11 | 7 | 5 | 297 | 224 | 235 | 250 | 205 |
| 749860 | 47 | 21 | 18 | 15 | 8 | 148 | 119 | 245 | 307 | 324 |
| 1065645 | 41 | 15 | 13 | 11 | 13 | 213 | 185 | 298 | 315 | 353 |
| 1263461 | 49 | 42 | 34 | 25 | 16 | 141 | 185 | 248 | 235 | 221 |
| 1263486 | 64 | 47 | 33 | 29 | 16 | 136 | 174 | 215 | 323 | 264 |

TABLE 75

Reduction of UBE3A-ATS RNA and increase of UBE3A RNA in Angelman Syndrome IPS cell derived neurons

| Compound ID | UBE3A-ATS RNA (% UTC) (RTS4796) | | | | | UBE3A RNA (% UTC) (RTS35984) | | | | |
|---|---|---|---|---|---|---|---|---|---|---|
| | 250 nM | 741 nM | 2222 nM | 6667 nM | 20000 nM | 250 nM | 741 nM | 2222 nM | 6667 nM | 20000 nM |
| 750519 | 46 | 22 | 13 | 7 | 7 | 259 | 274 | 520 | 482 | 272 |
| 1263517 | 37 | 29 | 16 | 12 | 12 | 230 | 261 | 462 | 521 | 283 |
| 1263518 | 66 | 39 | 29 | 21 | 18 | 187 | 183 | 269 | 496 | 277 |
| 1263532 | 39 | 26 | 21 | 17 | 24 | 192 | 162 | 393 | 390 | 357 |
| 1263533 | 34 | 25 | 24 | 18 | 29 | 296 | 367 | 389 | 371 | 548 |

TABLE 76

Reduction of UBE3A-ATS RNA and increase of UBE3A RNA in Angelman Syndrome IPS cell derived neurons

| Compound ID | UBE3A-ATS RNA (% UTC) (RTS4796) | | | | | UBE3A RNA (% UTC) (RTS35984) | | | | |
|---|---|---|---|---|---|---|---|---|---|---|
| | 250 nM | 741 nM | 2222 nM | 6667 nM | 20000 nM | 250 nM | 741 nM | 2222 nM | 6667 nM | 20000 nM |
| 617557 | 68 | 44 | 28 | 24 | 20 | 120 | 210 | 319 | 453 | 396 |
| 1263537 | 29 | 26 | 21 | 26 | 16 | 139 | 203 | 414 | 440 | 480 |
| 1272944 | 35 | 25 | 13 | 11 | 7 | 148 | 235 | 469 | 702 | 677 |
| 1273033 | 38 | 21 | 21 | 16 | 18 | 119 | 244 | 487 | 422 | 514 |
| 1273039 | 64 | 41 | 29 | 20 | 17 | 183 | 237 | 395 | 376 | 418 |

TABLE 77

Reduction of UBE3A-ATS RNA and increase of UBE3A RNA in Angelman Syndrome IPS cell derived neurons

| Compound ID | UBE3A-ATS RNA (% UTC) (RTS4796) | | | | | UBE3A RNA (% UTC) (RTS35984) | | | | |
|---|---|---|---|---|---|---|---|---|---|---|
| | 250 nM | 741 nM | 2222 nM | 6667 nM | 20000 nM | 250 nM | 741 nM | 2222 nM | 6667 nM | 20000 nM |
| 617557 | 63 | 50 | 33 | 28 | 27 | 126 | 230 | 347 | 335 | 368 |
| 1273050 | 64 | 48 | 59 | 41 | 28 | 165 | 152 | 240 | 457 | 483 |
| 1273055 | 44 | 31 | 38 | 22 | 17 | 541 | 664 | 1014 | 1094 | 887 |
| 1273062 | 34 | 54 | 51 | 47 | 27 | 253 | 296 | 421 | 705 | 997 |
| 1273090 | 70 | 54 | 30 | 39 | 23 | 155 | 165 | 259 | 487 | 692 |
| 1273091 | 91 | 86 | 54 | 37 | 31 | 96 | 121 | 135 | 156 | 284 |

Example 10

Tolerability of Modified Oligonucleotides Complementary to Human UBE3A-ATS in Wild-Type Mice, 3 Hour Study Modified oligonucleotides described above were tested in wild-type female C57/Bl6 mice to assess the tolerability of the oligonucleotides. Wild-type female C57/Bl6 mice each received a single ICV dose of 700 μg of modified oligonucleotide listed in the table below. Each treatment group consisted of 4 mice. A group of 4 mice received PBS as a negative control for each experiment (identified in separate tables below). At 3 hours post-injection, mice were evaluated according to seven different criteria. The criteria are (1) the mouse was bright, alert, and responsive; (2) the mouse was standing or hunched without stimuli; (3) the mouse showed any movement without stimuli; (4) the mouse demonstrated forward movement after it was lifted; (5) the mouse demonstrated any movement after it was lifted; (6) the mouse responded to tail pinching; (7) regular breathing. For each of the 7 criteria, a mouse was given a subscore of 0 if it met the criteria and 1 if it did not (the functional observational battery score or FOB). After all 7 criteria were evaluated, the scores were summed for each mouse and averaged within each treatment group. The results are presented in the tables below.

TABLE 78

Tolerability scores in mice at 700 μg dose

| Compound Number | 3 hr FOB |
|---|---|
| PBS | 0.0 |
| 749860 | 0.0 |
| 749865 | 4.0 |
| 749984 | 4.8 |
| 750006 | 3.5 |
| 750009 | 3.8 |
| 750540 | 3.5 |
| 750544 | 2.8 |
| 750567 | 5.0 |

TABLE 79

Tolerability scores in mice at 700 μg dose

| Compound Number | 3 hr FOB |
|---|---|
| PBS | 0 |
| 1065272 | 5.0 |
| 1065295 | 2.0 |
| 1065296 | 5.5 |
| 1065324 | 2.8 |
| 1065330 | 6.8 |
| 1065369 | 6.8 |
| 1065438 | 5.8 |
| 1065465 | 5.0 |
| 1065513 | 5.8 |
| 1065576 | 7.0 |
| 1065578 | 3.2 |
| 1065579 | 3.8 |
| 1065582 | 4.2 |
| 1065586 | 3.0 |
| 1065590 | 6.0 |

TABLE 79-continued

Tolerability scores in mice at 700 µg dose

| Compound Number | 3 hr FOB |
|---|---|
| 1065591 | 4.0 |
| 1065593 | 1.0 |
| 1065595 | 4.8 |
| 1065597 | 4.5 |
| 1065599 | 6.0 |
| 1065600 | 4.2 |
| 1065605 | 3.8 |
| 1065607 | 5.2 |
| 1065608 | 3.0 |

TABLE 80

Tolerability scores in mice at 700 µg dose

| Compound Number | 3 hr FOB |
|---|---|
| PBS | 0.0 |
| 1065609 | 0.0 |
| 1065613 | 0.0 |
| 1065616 | 5.5 |
| 1065619 | 5.0 |
| 1065621 | 2.0 |
| 1065623 | 3.5 |
| 1065624 | 3.5 |
| 1065631 | 1.0 |
| 1065635 | 1.0 |
| 1065641 | 1.5 |
| 1065642 | 4.0 |
| 1065644 | 6.8 |
| 1065645 | 3.0 |
| 1065646 | 2.0 |
| 1065651 | 4.0 |
| 1065654 | 7.0 |
| 1065667 | 4.0 |
| 1065669 | 1.0 |
| 1065671 | 4.0 |
| 1065672 | 6.8 |
| 1065674 | 4.0 |
| 1065676 | 2.0 |
| 1065678 | 5.0 |
| 1065680 | 1.0 |

TABLE 81

Tolerability scores in mice at 700 µg dose

| Compound Number | 3 hr FOB |
|---|---|
| PBS | 0 |
| 1065685 | 5.0 |
| 1065686 | 4.8 |
| 1065690 | 3.8 |
| 1065696 | 6.2 |
| 1065708 | 5.5 |
| 1065709 | 4.2 |
| 1065710 | 2.8 |
| 1065712 | 6.8 |
| 1065713 | 5.0 |
| 1065719 | 4.0 |
| 1065728 | 1.0 |
| 1065735 | 3.5 |
| 1065750 | 6.2 |
| 1065754 | 3.2 |
| 1065765 | 4.2 |
| 1065766 | 5.2 |
| 1065768 | 5.5 |
| 1065785 | 3.8 |
| 1065795 | 1.0 |
| 1065799 | 1.0 |
| 1065810 | 2.2 |
| 1065812 | 3.8 |

TABLE 81-continued

Tolerability scores in mice at 700 µg dose

| Compound Number | 3 hr FOB |
|---|---|
| 1065813 | 5.0 |
| 1065817 | 5.0 |

TABLE 82

Tolerability scores in mice at 700 µg dose

| Compound Number | 3 hr FOB |
|---|---|
| PBS | 0.0 |
| 1065821 | 6.5 |
| 1065823 | 4.0 |
| 1065826 | 3.0 |
| 1065829 | 4.8 |
| 1065840 | 4.5 |
| 1065856 | 6.2 |
| 1065857 | 6.0 |
| 1065858 | 4.0 |
| 1065859 | 0.0 |
| 1065863 | 4.8 |
| 1065868 | 3.2 |
| 1065889 | 1.0 |
| 1065894 | 3.8 |
| 1065899 | 4.5 |
| 1065901 | 4.0 |
| 1065902 | 4.0 |
| 1065903 | 5.5 |
| 1065914 | 5.0 |
| 1065920 | 2.0 |
| 1065932 | 4.5 |
| 1065937 | 1.0 |
| 1065947 | 1.2 |
| 1065953 | 6.5 |
| 1065954 | 5.5 |

TABLE 83

Tolerability scores in mice at 700 µg dose

| Compound Number | 3 hr FOB |
|---|---|
| PBS | 0.0 |
| 1065955 | 5.0 |
| 1065977 | 6.2 |
| 1066009 | 2.0 |
| 1066037 | 4.2 |
| 1066046 | 1.0 |
| 1066072 | 4.0 |
| 1066076 | 5.0 |
| 1066089 | 1.0 |
| 1066092 | 1.0 |
| 1066097 | 1.2 |
| 1066119 | 11.0 |
| 1066217 | 6.0 |
| 1066221 | 3.8 |
| 1066249 | 4.5 |
| 1066253 | 6.0 |
| 1066311 | 2.0 |
| 1066350 | 4.0 |
| 1066375 | 1.0 |
| 1066377 | 6.2 |
| 1066378 | 5.2 |
| 1066396 | 6.0 |
| 1066420 | 4.0 |
| 1066423 | 2.8 |
| 1066429 | 5.8 |

TABLE 84

Tolerability scores in mice at 700 μg dose

| Compound Number | 3 hr FOB |
|---|---|
| PBS | 0.0 |
| 749931 | 0.0 |
| 749933 | 4.0 |
| 749937 | 0.5 |
| 749944 | 3.8 |
| 749956 | 1.8 |
| 749964 | 2.0 |
| 749969 | 5.2 |
| 749991 | 2.2 |
| 750028 | 4.2 |
| 750030 | 3.2 |
| 750032 | 2.2 |
| 750040 | 4.2 |
| 750051 | 2.5 |
| 750092 | 0.8 |
| 750100 | 2.5 |
| 750131 | 0.5 |
| 750139 | 3.0 |
| 750140 | 1.2 |
| 750196 | 4.0 |
| 750210 | 3.5 |
| 750214 | 3.25 |
| 750228 | 0.0 |
| 750270 | 1.0 |
| 750292 | 0.0 |
| 750312 | 4.8 |
| 750325 | 1.0 |
| 750326 | 0.0 |
| 750329 | 5.5 |
| 750344 | 6.2 |
| 750350 | 2.8 |
| 750359 | 0.0 |
| 750360 | 3.2 |
| 750365 | 5.2 |
| 750366 | 0.0 |
| 750386 | 0.0 |
| 750413 | 0.0 |
| 750416 | 7.0 |
| 750418 | 1.8 |
| 750430 | 6.2 |
| 750431 | 5.0 |
| 750439 | 5.5 |
| 750452 | 2.5 |
| 750517 | 3.0 |
| 750519 | 1.0 |
| 750542 | 3.5 |
| 750549 | 0.0 |

TABLE 85

Tolerability scores in mice at 700 μg dose

| Compound Number | 3 hr FOB |
|---|---|
| PBS | 0.0 |
| 617456 | 4.8 |
| 617459 | 7.0 |
| 617470 | 6.5 |
| 617473 | 6.8 |
| 617536 | 6.5 |
| 617547 | 6.8 |
| 617557 | 5.2 |
| 617593 | 6.5 |
| 749794 | 5.0 |
| 749796 | 4.5 |
| 749816 | 5.8 |
| 749861 | 3.0 |
| 749863 | 5.5 |
| 749869 | 3.8 |
| 749882 | 6.8 |
| 749885 | 0.5 |
| 749893 | 1.2 |
| 749894 | 0.0 |
| 749907 | 5.0 |
| 749921 | 6.0 |

TABLE 86

Tolerability scores in mice at 700 μg dose

| Compound Number | 3 hr FOB |
|---|---|
| PBS | 0.0 |
| 1065473 | 3.2 |
| 1065561 | 6.0 |
| 1065592 | 4.0 |
| 1065625 | 7.0 |
| 1065791 | 1.0 |
| 1065924 | 1.0 |
| 1066003 | 4.0 |

TABLE 87

Tolerability scores in mice at 700 μg dose

| Compound ID | 3 hr FOB |
|---|---|
| PBS | 0.0 |
| 1263471 | 6.2 |
| 1263472 | 3.2 |
| 1263473 | 1.0 |
| 1263474 | 0.0 |
| 1263475 | 0.0 |
| 1263476 | 1.0 |
| 1263477 | 0.0 |
| 1263478 | 1.0 |
| 1263479 | 4.0 |
| 1263480 | 4.0 |
| 1263481 | 5.5 |
| 1263482 | 4.0 |
| 1263483 | 4.0 |
| 1263484 | 4.0 |
| 1263485 | 4.0 |
| 1263486 | 2.0 |
| 1263487 | 1.0 |
| 1263488 | 1.0 |
| 1263489 | 0.0 |
| 1263490 | 0.0 |
| 1263491 | 0.0 |
| 1263492 | 1.0 |
| 1263494 | 4.0 |
| 1263495 | 4.0 |
| 1263496 | 4.0 |
| 1263497 | 4.0 |
| 1263498 | 4.0 |
| 1263499 | 4.0 |
| 1263500 | 4.7 |
| 1263501 | 5.5 |
| 1263502 | 4.0 |
| 1263503 | 4.0 |
| 1263504 | 1.0 |
| 1263505 | 0.0 |
| 1263506 | 0.0 |
| 1263507 | 0.0 |
| 1263508 | 0.0 |
| 1263509 | 0.0 |
| 1263510 | 2.0 |

TABLE 88

Tolerability scores in mice at 700 μg dose

| Compound ID | 3 hr FOB |
|---|---|
| PBS | 0.0 |
| 1165878 | 4.0 |
| 1263511 | 4.0 |
| 1263512 | 6.0 |
| 1263513 | 6.0 |
| 1263514 | 6.5 |
| 1263515 | 4.0 |
| 1263516 | 4.0 |
| 1263517 | 1.0 |
| 1263518 | 0.0 |
| 1263519 | 1.0 |
| 1263520 | 1.0 |
| 1263521 | 0.0 |
| 1263522 | 0.0 |
| 1263523 | 1.0 |
| 1263524 | 5.2 |
| 1263525 | 4.8 |
| 1263526 | 4.0 |
| 1263527 | 4.0 |
| 1263528 | 4.0 |
| 1263529 | 3.0 |
| 1263530 | 4.0 |
| 1263531 | 5.2 |
| 1263532 | 1.0 |
| 1263533 | 1.0 |
| 1263534 | 1.0 |
| 1263535 | 4.0 |
| 1263536 | 2.0 |
| 1263537 | 1.0 |
| 1263538 | 3.0 |
| 1263539 | 1.0 |
| 1263540 | 0.0 |

TABLE 89

Tolerability scores in mice at 700 μg dose

| Compound ID | 3 hr FOB |
|---|---|
| PBS | 0.0 |
| 1263541 | 1.8 |
| 1263542 | 3.5 |
| 1263543 | 1.0 |
| 1263544 | 1.0 |
| 1263545 | 2.0 |
| 1263546 | 0.0 |
| 1263547 | 1.0 |
| 1263548 | 1.0 |
| 1263549 | 0.0 |
| 1263550 | 1.0 |
| 1263551 | 2.0 |
| 1263552 | 1.0 |
| 1263553 | 5.5 |
| 1263554 | 1.0 |
| 1263555 | 4.0 |
| 1263556 | 1.0 |
| 1263557 | 1.0 |

TABLE 90

Tolerability scores in mice at 700 μg dose

| Compound ID | 3 hr FOB |
|---|---|
| PBS | 0.0 |
| 1263403 | 5.3 |
| 1263404 | 4.3 |
| 1263405 | 6.3 |
| 1263406 | 4.7 |
| 1263407 | 2.3 |
| 1263408 | 0.3 |
| 1263409 | 0.0 |
| 1263410 | 0.0 |
| 1263411 | 0.0 |
| 1263412 | 2.0 |
| 1263413 | 2.3 |
| 1263414 | 5.3 |
| 1263415 | 4.0 |
| 1263416 | 7.0 |
| 1263417 | 3.3 |
| 1263418 | 3.0 |
| 1263419 | 1.7 |
| 1263420 | 1.0 |
| 1263421 | 3.0 |
| 1263422 | 4.3 |
| 1263423 | 6.0 |
| 1263424 | 6.3 |
| 1263425 | 5.0 |

TABLE 91

Tolerability scores in mice at 700 μg dose

| Compound ID | 3 hr FOB |
|---|---|
| PBS | 0.0 |
| 749952 | 6.0 |
| 749953 | 3.3 |
| 1165583 | 5.7 |
| 1165584 | 3.3 |
| 1263426 | 2.0 |
| 1263427 | 4.0 |
| 1263428 | 4.3 |
| 1263429 | 1.3 |
| 1263430 | 2.3 |
| 1263431 | 6.3 |
| 1263432 | 6.0 |
| 1263433 | 4.7 |
| 1263434 | 1.0 |
| 1263435 | 1.3 |
| 1263436 | 2.3 |
| 1263437 | 4.7 |
| 1263438 | 6.0 |
| 1263439 | 4.7 |
| 1263440 | 6.7 |
| 1263441 | 0.3 |
| 1263442 | 3.7 |
| 1263443 | 3.0 |
| 1263444 | 6.3 |
| 1263445 | 5.0 |
| 1263446 | 5.7 |
| 1263447 | 4.7 |
| 1263448 | 5.0 |
| 1263449 | 4.7 |
| 1263450 | 2.0 |
| 1263451 | 1.3 |
| 1263452 | 0 |
| 1263453 | 0 |

TABLE 92

Tolerability scores in mice at 700 μg dose

| Compound ID | 3 hr FOB |
|---|---|
| PBS | 0 |
| 1065786 | 2.0 |
| 1165526 | 0.7 |
| 1165577 | 3.7 |
| 1263454 | 0.0 |
| 1263455 | 0.0 |
| 1263456 | 3.3 |

TABLE 92-continued

Tolerability scores in mice at 700 μg dose

| Compound ID | 3 hr FOB |
|---|---|
| 1263457 | 5.3 |
| 1263458 | 1.3 |
| 1263459 | 1.0 |
| 1263460 | 1.0 |
| 1263461 | 1.0 |
| 1263462 | 1.0 |
| 1263463 | 1.0 |
| 1263464 | 1.3 |
| 1263465 | 1.7 |
| 1263466 | 5.0 |
| 1263467 | 6.0 |
| 1263468 | 4.3 |
| 1263469 | 7.0 |
| 1263470 | 6.7 |
| 1272943 | 2.0 |
| 1272944 | 2.3 |
| 1272945 | 2.7 |
| 1272946 | 0.0 |
| 1272947 | 0.0 |
| 1272948 | 3.3 |
| 1272949 | 4.0 |
| 1272950 | 3.7 |
| 1272951 | 0.7 |
| 1272952 | 2.0 |
| 1272953 | 0.3 |
| 1272954 | 1.0 |

TABLE 93

Tolerability scores in mice at 700 μg dose

| Compound ID | 3 hr FOB |
|---|---|
| PBS | 0.0 |
| 1272955 | 3.7 |
| 1272956 | 5.3 |
| 1272957 | 4.0 |
| 1272958 | 5.0 |
| 1272959 | 3.3 |
| 1272960 | 1.0 |
| 1272961 | 4.7 |
| 1272962 | 2.0 |
| 1272963 | 4.0 |
| 1272964 | 2.3 |
| 1272965 | 1.0 |
| 1272966 | 2.3 |
| 1272967 | 1.0 |
| 1272968 | 1.0 |
| 1272969 | 0.0 |
| 1272970 | 0.0 |
| 1272971 | 0.0 |
| 1272972 | 0.0 |
| 1272973 | 4.0 |
| 1272974 | 1.0 |
| 1272975 | 1.0 |
| 1272976 | 2.0 |
| 1272977 | 1.0 |
| 1272978 | 2.3 |
| 1272979 | 1.0 |

TABLE 94

Tolerability scores in mice at 700 μg dose

| Compound ID | 3 hr FOB |
|---|---|
| PBS | 0.0 |
| 1272980 | 3.3 |
| 1272981 | 3.3 |
| 1272982 | 1.0 |
| 1272983 | 1.0 |

TABLE 94-continued

Tolerability scores in mice at 700 μg dose

| Compound ID | 3 hr FOB |
|---|---|
| 1272984 | 4.0 |
| 1272985 | 1.0 |
| 1272986 | 4.7 |
| 1272987 | 1.0 |
| 1272988 | 1.0 |
| 1272989 | 1.0 |
| 1272990 | 4.0 |
| 1272991 | 4.0 |
| 1272992 | 0.0 |
| 1272993 | 0.0 |
| 1272994 | 1.0 |
| 1272995 | 1.0 |
| 1272996 | 0.7 |
| 1272997 | 1.0 |
| 1272998 | 0.0 |
| 1272999 | 5.0 |
| 1273000 | 0.0 |
| 1273001 | 3.0 |
| 1273002 | 3.7 |
| 1273003 | 2.7 |
| 1273004 | 3.0 |
| 1273005 | 4.0 |
| 1273006 | 3.3 |
| 1273007 | 3.0 |
| 1273008 | 3.3 |
| 1273009 | 1.0 |
| 1273010 | 4.7 |
| 1273011 | 1.0 |

TABLE 95

Tolerability scores in mice at 700 μg dose

| Compound ID | 3 hr FOB |
|---|---|
| PBS | 0.0 |
| 699781 | 0.0 |
| 1065707 | 2.0 |
| 1065711 | 4.0 |
| 1065921 | 5.7 |
| 1165585 | 3.7 |
| 1165621 | 1.0 |
| 1273012 | 0.0 |
| 1273013 | 4.0 |
| 1273014 | 2.0 |
| 1273015 | 2.0 |
| 1273016 | 0.0 |
| 1273017 | 1.0 |
| 1273018 | 0.0 |
| 1273019 | 0.0 |
| 1273020 | 0.0 |
| 1273021 | 0.0 |
| 1273022 | 0.0 |
| 1273023 | 0.0 |
| 1273024 | 0.0 |
| 1273025 | 5.0 |
| 1273026 | 5.3 |
| 1273027 | 5.0 |
| 1273028 | 0.0 |
| 1273029 | 4.7 |
| 1273030 | 3.0 |
| 1273031 | 0.0 |
| 1273032 | 0.0 |
| 1273033 | 0.0 |

TABLE 96

Tolerability scores in mice at 700 µg dose

| Compound ID | 3 hr FOB |
|---|---|
| PBS | 0.0 |
| 1273034 | 0.0 |
| 1273035 | 1.0 |
| 1273036 | 1.0 |
| 1273037 | 1.0 |
| 1273038 | 1.0 |
| 1273039 | 1.0 |
| 1273040 | 0.0 |
| 1273041 | 0.0 |
| 1273042 | 0.0 |
| 1273043 | 6.0 |
| 1273044 | 0.0 |
| 1273045 | 0.0 |
| 1273046 | 3.0 |
| 1273047 | 3.0 |
| 1273048 | 0.0 |
| 1273049 | 0.0 |
| 1273050 | 0.0 |
| 1273051 | 0.0 |
| 1273052 | 0.0 |
| 1273053 | 6.0 |
| 1273054 | 3.0 |
| 1273055 | 2.0 |
| 1273056 | 2.3 |
| 1273057 | 2.0 |
| 1273058 | 1.0 |
| 1273059 | 1.0 |
| 1273060 | 0.7 |
| 1273061 | 1.0 |
| 1273062 | 0.0 |
| 1273063 | 0.0 |
| 1273064 | 0.0 |
| 1273065 | 0.0 |
| 1273066 | 0.0 |
| 1273067 | 1.0 |
| 1273068 | 6.0 |
| 1273069 | 6.0 |
| 1273070 | 1.0 |
| 1273071 | 0.0 |
| 1273072 | 0.0 |
| 1273073 | 4.0 |
| 1273084 | 0.0 |
| 1273085 | 3.0 |
| 1273086 | 2.0 |
| 1273087 | 1.0 |
| 1273088 | 0.0 |
| 1273089 | 5.3 |
| 1273090 | 0.0 |
| 1273091 | 0.0 |
| 1273092 | 0.0 |
| 1273093 | 1.0 |
| 1273094 | 6.0 |
| 1273095 | 4.3 |
| 1273096 | 4.7 |
| 1273097 | 5.0 |
| 1273098 | 1.0 |
| 1273099 | 1.0 |
| 1273101 | 0.7 |
| 1273102 | 1.0 |
| 1273103 | 0.0 |
| 1273104 | 0.0 |
| 1273105 | 0.0 |
| 1273106 | 0.0 |
| 1273107 | 0.0 |
| 1273108 | 0.0 |
| 1273109 | 1.0 |
| 1273110 | 0.0 |
| 1273111 | 0.0 |
| 1273112 | 2.3 |
| 1273113 | 0.0 |
| 1273114 | 0.0 |
| 1273115 | 2.3 |

TABLE 97

Tolerability scores in mice at 700 µg dose

| Compound ID | 3 hr FOB |
|---|---|
| PBS | 0.0 |
| 1165523 | 2.0 |
| 1165533 | 2.3 |
| 1165538 | 3.0 |
| 1165550 | 1.3 |
| 1165563 | 1.3 |
| 1165586 | 2.3 |
| 1165596 | 2.3 |
| 1165608 | 4.0 |
| 1165616 | 3.0 |
| 1165694 | 3.3 |
| 1165737 | 3.7 |
| 1165827 | 3.3 |
| 1165855 | 3.0 |
| 1165897 | 0.3 |
| 1179808 | 2.3 |
| 1179839 | 6.7 |
| 1179841 | 2.0 |
| 1179843 | 2.0 |
| 1273100 | 7.0 |

TABLE 98

Tolerability scores in mice at 700 µg dose

| Compound Number | 3 hr FOB |
|---|---|
| PBS | 0.0 |
| 1165521 | 3.3 |
| 1165524 | 4.7 |
| 1165536 | 4.0 |
| 1165545 | 6.0 |
| 1165552 | 5.7 |
| 1165553 | 6.0 |
| 1165554 | 7.0 |
| 1165555 | 6.0 |
| 1165562 | 5.7 |
| 1165588 | 4.7 |
| 1165590 | 5.7 |
| 1165611 | 6.0 |

Example 11

Tolerability of Modified Oligonucleotides Complementary to Human UBE3A-ATS in Rats, 3 Hour Study Modified oligonucleotides described above were tested in rats to assess the tolerability of the oligonucleotides. Sprague Dawley rats each received a single intrathecal (IT) dose of 3 mg of oligonucleotide listed in the table below. Each treatment group consisted of 4 rats. A group of four rats received PBS as a negative control. At 3 hours post-injection, movement in 7 different parts of the body were evaluated for each rat. The 7 body parts are (1) the rat's tail; (2) the rat's posterior posture; (3) the rat's hind limbs; (4) the rat's hind paws; (5) the rat's forepaws; (6) the rat's anterior posture; (7) the rat's head. For each of the 7 different body parts, each rat was given a sub-score of 0 if the body part was moving or 1 if the body part was paralyzed (the functional observational battery score or FOB). After each of the 7 body parts were evaluated, the sub-scores were summed for each rat and then averaged for each group. For example, if a rat's tail, head, and all other evaluated body parts were moving 3 hours after the 3 mg IT dose, it would get a summed score of 0. If another rat was not moving its tail 3 hours after the 3 mg IT dose but all other evaluated body parts were moving, it would receive a score of 1. Results are presented as the average score for each treatment group.

TABLE 99

Tolerability scores in rats at 3 mg dose

| Compound No. | FOB 3 hr |
|---|---|
| PBS | 0.0 |
| 749860 | 0.0 |
| 749861 | 4.0 |
| 749869 | 4.8 |
| 749885 | 0.8 |
| 749893 | 0.5 |
| 749931 | 0.5 |
| 750006 | 4.5 |

TABLE 100

Tolerability scores in rats at 3 mg dose

| Compound No. | FOB 3 hr |
|---|---|
| PBS | 0.0 |
| 750030 | 4.0 |
| 750051 | 4.0 |
| 750092 | 2.5 |
| 750100 | 4.0 |
| 750139 | 5.3 |
| 750140 | 3.5 |
| 750270 | 3.0 |
| 750292 | 0.0 |
| 750325 | 1.8 |
| 750386 | 0.8 |

TABLE 101

Tolerability scores in rats at 3 mg dose

| Compound No. | FOB 3 hr |
|---|---|
| PBS | 0.0 |
| 1065578 | 4.0 |
| 1065586 | 3.0 |
| 1065609 | 2.0 |
| 1065613 | 3.8 |
| 1065635 | 1.8 |
| 1065641 | 3.3 |
| 1065645 | 3.0 |
| 1065646 | 2.5 |

TABLE 102

Tolerability scores in rats at 3 mg dose

| Compound No. | FOB 3 hr |
|---|---|
| PBS | 0.0 |
| 750413 | 0.3 |
| 1065669 | 2.8 |
| 1065680 | 4.0 |
| 1065710 | 5.5 |
| 1065754 | 5.3 |
| 1065785 | 6.0 |
| 1065795 | 3.3 |
| 1065799 | 2.0 |
| 1065812 | 4.0 |
| 1065826 | 2.0 |

TABLE 103

Tolerability scores in rats at 3 mg dose

| Compound No. | FOB 3 hr |
|---|---|
| PBS | 0.0 |
| 1065920 | 3.5 |
| 1065937 | 3.8 |
| 1066092 | 3.3 |
| 1066221 | 4.0 |
| 1066350 | 2.3 |

TABLE 104

Tolerability scores in rats at 3 mg dose

| Compound No. | FOB 3 hr |
|---|---|
| PBS | 0.3 |
| 1263408 | 2.0 |
| 1263409 | 2.5 |
| 1263410 | 2.5 |
| 1263411 | 1.3 |
| 1263412 | 3.0 |
| 1263419 | 1.8 |
| 1263420 | 1.8 |
| 1263429 | 2.5 |
| 1263434 | 2.0 |

TABLE 105

Tolerability scores in rats at 3 mg dose

| Compound No. | FOB 3 hr |
|---|---|
| PBS | 0.3 |
| 1263435 | 3.0 |
| 1263441 | 2.3* |
| 1263450 | 2.0 |
| 1263451 | 4.0 |
| 1263452 | 2.0 |
| 1263453 | 1.8 |
| 1263454 | 1.5 |
| 1263455 | 3.3 |
| 1263458 | 0.3 |

*One of the four rats in this group died during surgery, and so is excluded from this value.

TABLE 106

Tolerability scores in rats at 3 mg dose

| Compound No. | FOB 3 hr |
|---|---|
| PBS | 0.5 |
| 1263476 | 0.3 |
| 1263478 | 1.0 |
| 1263488 | 3.0 |
| 1263489 | 2.3 |
| 1263507 | 2.0 |
| 1263517 | 1.3 |
| 1263518 | 1.8 |
| 1263519 | 1.0 |
| 1263521 | 2.0 |
| 1263533 | 1.3 |

TABLE 107

Tolerability scores in rats at 3 mg dose

| Compound No. | FOB 3 hr |
|---|---|
| PBS | 0.0 |
| 1165563 | 3.0 |
| 1179841 | 3.0 |
| 1179843 | 3.3 |
| 1263407 | 3.8 |
| 1263413 | 4.0 |
| 1263430 | 4.3 |
| 1263436 | 2.8 |
| 1263540 | 2.5 |
| 1272944 | 2.0 |
| 1272994 | 1.0 |
| 1272996 | 1.0 |

TABLE 108

Tolerability scores in rats at 3 mg dose

| Compound No. | FOB 3 hr |
|---|---|
| PBS | 0.0 |
| 1272998 | 0.3 |
| 1273034 | 0.0 |
| 1273035 | 0.8 |
| 1273036 | 0.0 |
| 1273049 | 0.3 |
| 1273051 | 0.0. |
| 1273055 | 2.0 |
| 1273056 | 3.7 |
| 1273057 | 1.0 |
| 1273058 | 0.8 |
| 1273062 | 2.5 |
| 1273065 | 2.3 |
| 1273087 | 2.0 |
| 1273099 | 2.5 |
| 1273102 | 4.5 |
| 1273106 | 2.0 |
| 1273107 | 2.0 |
| 1273108 | 2.0 |
| 1273113 | 1.0 |
| 1273115 | 3.3 |
| 1165523 | 5.0 |
| 1165550 | 3.0 |

TABLE 109

Tolerability scores in rats at 3 mg dose

| Compound No. | FOB 3 hr |
|---|---|
| PBS | 0.0 |
| 1263426 | 2.3 |
| 1263462 | 2.8 |
| 1272974 | 3.8 |
| 1272997 | 0.8 |
| 1273020 | 0.5 |
| 1273033 | 1.8 |
| 1273038 | 3.0 |
| 1273039 | 3.3 |
| 1273042 | 2.0 |
| 1273048 | 3.0 |
| 1273104 | 3.0 |
| 1273105 | 3.0 |
| 1273109 | 3.8 |
| 1273110 | 1.0 |
| 1273111 | 2.7 |
| 1065593 | 1.5 |
| 1263547 | 4.0 |
| 1165586 | 0.0 |
| 1263537 | 1.5 |

TABLE 110

Tolerability scores in rats at 3 mg dose

| Compound No. | FOB 3 hr |
|---|---|
| PBS | 0.0 |
| 749953 | 4.5 |
| 1065711 | 3.5 |
| 1263417 | 6.3 |
| 1263418 | 3.3 |
| 1263421 | 5.8 |
| 1263443 | 5.0 |
| 1263456 | 5.0 |
| 1263529 | 2.5 |
| 1263538 | 4.7 |
| 1273030 | 0.0 |
| 1273047 | 4.0 |
| 1273085 | 4.0 |

TABLE 111

Tolerability scores in rats at 3 mg dose

| Compound No. | FOB 3 hr |
|---|---|
| PBS | 0.0 |
| 749991 | 1.3 |
| 1263460 | 3.0 |
| 1263461 | 2.0 |
| 1263486 | 3.0 |
| 1263532 | 1.5 |
| 1263551 | 4.0 |
| 1273050 | 1.0 |
| 1273090 | 1.0 |
| 1273091 | 2.0 |
| 1273101 | 3.5 |
| 1263522 | 1.7 |

Example 12

Tolerability of Modified Oligonucleotides Complementary to Human UBE3A-ATS in Wild-Type Mice, Two Week Study Modified oligonucleotides described above were tested in wild-type female C57/B16 mice to assess the tolerability of the oligonucleotides. Wild-type female C57/B16 mice each received a single ICV dose of 700 µg of modified oligonucleotide listed in the table below. Each treatment group consisted of 4 mice. A group of 4 mice received PBS as a negative control for each experiment (identified in separate tables below). At 2 weeks post-injection, mice were evaluated according to seven different criteria. The criteria are (1) the mouse was bright, alert, and responsive; (2) the mouse was standing or hunched without stimuli; (3) the mouse showed any movement without stimuli; (4) the mouse demonstrated forward movement after it was lifted; (5) the mouse demonstrated any movement after it was lifted; (6) the mouse responded to tail pinching; (7) regular breathing. For each of the 7 criteria, a mouse was given a subscore of 0 if it met the criteria and 1 if it did not (the functional observational battery score or FOB). After all 7 criteria were evaluated, the scores were summed for each mouse and averaged within each treatment group. The results are presented in the table below.

TABLE 112

Tolerability scores in mice at 700 µg dose

| Compound Number | 2-week FOB |
|---|---|
| PBS | 0.0 |
| 1065645 | 0.0 |
| 1263517 | 0.0 |
| 1263518 | 0.0 |
| 1263533 | 0.0 |
| 1273039 | 0.0 |
| 1273062 | 0.0 |

Example 13

Activity of Modified Oligonucleotides Complementary to Human UBE3A-ATS in Transgenic Mice Modified oligonucleotides described above were tested in a UBE3A-ATS BAC transgenic mouse model. The transgenic mouse model was developed at the University of Michigan Bacterial Artificial Chromosome Recombineering Core and contains region 25163935-25348867 from human chromosome 15 (GRCh38/hg38 assembly) (from BAC clone RP11-664B13). UBE3A-ATS expression is driven by the ENO2 promoter and terminated with the BGH poly(A) signal. The gene fragment was introduced into fertilized eggs from C57BL/6 mice by pronuclear injection to produce line RP11-748 that is used in the experiments described below.

Treatment

The UBE3A-ATS transgenic mice were divided into groups of 2-4 mice each. Each mouse received a single ICV bolus of 350 µg of modified oligonucleotide. A group of 4 mice received PBS as a negative control.

RNA Analysis

After two weeks, mice were sacrificed and RNA was extracted from cortical brain tissue, hippocampal brain tissue, and spinal cord for real-time PCR analysis of measurement of RNA expression of UBE3A-ATS using primer probe set RTS4796 (described herein above) and/or primer probe set RTS40595 (forward sequence TCCTTCCCTACCTTAGTCTTGA, designated herein as SEQ ID NO: 14; reverse sequence CCCTCTTGAACCAGGAAACA, designated herein as SEQ ID NO: 15; probe sequence AGATGGCAGCCCACATTTCTACTGT, designated herein as SEQ ID NO: 16). Primer probe set RTS4796 is less reliable when the oligonucleotide binds at a site far from the primer probe binding site. Results are presented as percent change of RNA, relative to PBS control, normalized to mouse GAPDH. Mouse GAPDH was amplified using primer probe set RTS108 (forward sequence GGCAAATTCAACGGCACAGT, designated herein as SEQ ID NO: 11; reverse sequence GGGTCTCGCTCCTGGAAGAT, designated herein as SEQ ID NO: 12; probe sequence AAGGCCGAGAATGGGAAGCTTGTCATC, designated herein as SEQ ID NO: 13). In some cases, RTPCR value is not defined for a certain sample, and is labeled N.D. (Not Defined).

As shown in the table below, treatment with modified oligonucleotides resulted in reduction of UBE3A-ATS RNA in comparison to the PBS control.

TABLE 113

Reduction of human UBE3A-ATS RNA in transgenic mice

| Compound ID | UBE3A-ATS RNA (% control) RTS4796 | | | UBE3A-ATS RNA (% control) RTS40595 | | |
|---|---|---|---|---|---|---|
| | SPINAL CORD | HIPPO-CAMPUS | COR-TEX | SPINAL CORD | HIPPO-CAMPUS | COR-TEX |
| PBS | 100 | 100 | 100 | 100 | 100 | 100 |
| 749860 | 14 | N.D. | 26 | 12 | 24 | 23 |
| 749861 | 27 | N.D. | 51 | 26 | 48 | 49 |
| 749863 | 39 | N.D. | 57 | 36 | 45 | 54 |
| 749865 | 61 | N.D. | 92 | 66 | 97 | 85 |
| 749869 | 31 | 37 | 51 | 29 | 38 | 47 |
| 749882 | 31 | 28 | 35 | 30 | 30 | 32 |
| 749885 | 59 | 65 | 85 | 61 | 68 | 83 |
| 749893 | 28 | 35 | 44 | 27 | 35 | 40 |
| 749894 | 5 | 7 | 9 | 3 | 6 | 7 |
| 749907 | 53 | 48 | 70 | 51 | 47 | 63 |
| 749931 | 35 | 24 | 33 | 15 | 22 | 28 |
| 749969 | 17 | 14 | 14 | 11 | 13 | 10 |
| 749991 | 27 | 26 | 38 | 22 | 24 | 31 |
| 750006 | 24 | 21 | 24 | 19 | 19 | 18 |
| 750028 | 26 | 22 | 34 | 17 | 19 | 26 |
| 750030 | 40 | 30 | 44 | 32 | 26 | 34 |
| 750032 | 17 | 9 | 12 | 10 | 6 | 6 |
| 750040 | 55 | 42 | 65 | 50 | 44 | 59 |
| 750051 | 35 | 27 | 35 | 27 | 26 | 29 |
| 750092 | 55 | 43 | 63 | 47 | 40 | 53 |
| 750139 | 24 | 22 | 30 | 17 | 20 | 23 |
| 750140 | 22 | 16 | 22 | 15 | 13 | 15 |
| 750214 | 48 | 46 | 60 | 45 | 41 | 55 |
| 750292 | 27 | 35 | 40 | 21 | 31 | 34 |
| 750312 | 59 | 48 | 47 | 53 | 43 | 42 |
| 750359 | 30 | 23 | 25 | 25 | 19 | 20 |
| 750360 | 44 | 40 | 54 | 39 | 37 | 47 |
| 750365 | 58 | 69 | 88 | 56 | 65 | 82 |
| 750386 | 34 | 24 | 27 | 26 | 19 | 19 |
| 750413 | 45 | 37 | 38 | 36 | 34 | 30 |
| 750430 | 48 | 42 | 41 | 41 | 42 | 33 |
| 750439 | 53 | 46 | 52 | 34 | 44 | 46 |
| 1065296 | 34 | 34 | 39 | 31 | 34 | 34 |
| 1065578 | 35 | 42 | 49 | 34 | 42 | 42 |
| 1065579 | 19 | 18 | 19 | 17 | 18 | 14 |
| 1065586 | 45 | 55 | 74 | 43 | 55 | 68 |
| 1065590 | 43 | 53 | 67 | 42 | 51 | 63 |
| 1065591 | 21 | 24 | 29 | 19 | 21 | 25 |
| 1065595 | 25 | 34 | 49 | 13 | 30 | 41 |
| 1065599 | 19 | 22 | 27 | 18 | 22 | 24 |
| 1065600 | 31 | 35 | 42 | 32 | 35 | 39 |
| 1065605 | 44 | 64 | 67 | 44 | 62 | 63 |
| 1065607 | 28 | 36 | 39 | 29 | 33 | 34 |
| 1065608 | 18 | 42 | 53 | 18 | 38 | 49 |
| 1065623 | 16 | 28 | 34 | 15 | 29 | 30 |
| 1065635 | 32 | 39 | 41 | 30 | 38 | 36 |
| 1065641 | 32 | 55 | 50 | 30 | 49 | 44 |
| 1065642 | 43 | 58 | 65 | 42 | 52 | 59 |
| 1065645 | 18 | 30 | 24 | 15 | 24 | 18 |
| 1065646 | 39 | 60 | 50 | 39 | 54 | 45 |
| 1065651 | 29 | 47 | 38 | 28 | 43 | 34 |
| 1065667 | 23 | 30 | 26 | 19 | 24 | 22 |
| 1065671 | 21 | 29 | 30 | 18 | 25 | 26 |
| 1065685 | 71 | 76 | 82 | 40 | 68 | 71 |
| 1065690 | 12 | 16 | 20 | 9 | 12 | 15 |
| 1065708 | 28 | 38 | 33 | 24 | 31 | 27 |
| 1065710 | 29 | 34 | 32 | 27 | 29 | 26 |
| 1065713 | 31 | 34 | 40 | 29 | 29 | 34 |
| 1065765 | 25 | 27 | 33 | 21 | 22 | 28 |
| 1065813 | 38 | 49 | 67 | 34 | 41 | 62 |
| 1065823 | 37 | 33 | 36 | 30 | 24 | 28 |
| 1065858 | 23 | 25 | 21 | 15 | 14 | 13 |
| 1065859 | 29 | 20 | 22 | 19 | 11 | 13 |
| 1065863 | 52 | 45 | 39 | 39 | 34 | 29 |
| 1065868 | 22 | 19 | 19 | 14 | 13 | 12 |
| 1065920 | 47 | 60 | 56 | 45 | 51 | 44 |
| 1065932 | 28 | 33 | 35 | 23 | 25 | 26 |
| 1065947 | 34 | 35 | 40 | 28 | 25 | 30 |
| 1066221 | 44 | 74 | 76 | 43 | 69 | 69 |
| 1066420 | 55 | 74 | 71 | 52 | 71 | 61 |

TABLE 113-continued

Reduction of human UBE3A-ATS RNA in transgenic mice

| Compound ID | UBE3A-ATS RNA (% control) RTS4796 | | | UBE3A-ATS RNA (% control) RTS40595 | | |
|---|---|---|---|---|---|---|
| | SPINAL CORD | HIPPO-CAMPUS | COR-TEX | SPINAL CORD | HIPPO-CAMPUS | COR-TEX |
| 1066423 | 43 | 42 | 39 | 37 | 35 | 32 |
| 1066429 | 75 | 74 | 83 | 70 | 65 | 72 |

TABLE 114

Reduction of human UBE3A-ATS RNA in transgenic mice

| Compound ID | UBE3A-ATS RNA (% control) RTS4796 | | | UBE3A-ATS RNA (% control) RTS40595 | | |
|---|---|---|---|---|---|---|
| | SPINAL CORD | HIPPO-CAMPUS | COR-TEX | SPINAL CORD | HIPPO-CAMPUS | COR-TEX |
| PBS | 100 | 100 | 100 | 100 | 100 | 100 |
| 1065272 | 40 | 29 | 39 | 37 | 31 | 39 |
| 1065582 | 45 | 28 | 52 | 43 | 31 | 51 |
| 1065616 | 38 | 25 | 45 | 36 | 25 | 42 |
| 1065619 | 33 | 23 | 54 | 31 | 27 | 55 |
| 1065621 | 42 | 33 | 57 | 43 | 41 | 54 |
| 1065624 | 20 | 40 | 62 | 20 | 42 | 61 |
| 1065631 | 24 | 32 | 71 | 24 | 34 | 65 |
| 1065669 | 38 | 33 | 89 | 34 | 30 | 72 |
| 1065674 | 37 | 36 | 111 | 35 | 34 | 101 |
| 1065678 | 33 | 36 | 105 | 32 | 35 | 96 |
| 1065680 | 43 | 61 | 134 | 40 | 59 | 121 |
| 1065686 | 21 | 25 | 63 | 19 | 22 | 55 |
| 1065696 | 44 | 36 | 117 | 40 | 32 | 108 |
| 1065719 | 63 | 36 | 122 | 56 | 32 | 109 |
| 1065728 | 20 | 11 | 53 | 14 | 9 | 42 |
| 1065754 | 47 | 25 | 112 | 41 | 24 | 105 |
| 1065766 | 29 | 41 | 110 | 24 | 41 | 98 |
| 1065768 | 40 | 41 | 99 | 32 | 38 | 84 |
| 1065799 | 44 | 43 | 104 | 38 | 40 | 99 |
| 1065812 | 19 | 15 | 35 | 12 | 12 | 26 |
| 1065817 | 29 | 23 | 60 | 22 | 20 | 52 |
| 1065821 | 23 | 19 | 42 | 16 | 17 | 34 |
| 1065829 | 36 | 19 | 80 | 27 | 18 | 58 |
| 1065840 | 27 | 15 | 61 | 21 | 14 | 45 |
| 1065856 | 22 | 19 | 44 | 14 | 13 | 30 |
| 1065857 | 35 | 28 | 58 | 26 | 21 | 38 |
| 1065899 | 37 | 30 | 77 | 30 | 24 | 58 |
| 1065902 | 21 | 17 | 55 | 17 | 14 | 41 |
| 1065937 | 22 | 12 | 91 | 17 | 11 | 65 |
| 1065953 | 19 | 13 | 58 | 13 | 10 | 41 |
| 1065955 | 34 | 19 | 69 | 26 | 16 | 53 |
| 1066046 | 58 | 35 | 122 | 50 | 32 | 106 |
| 1066076 | 46 | 27 | 76 | 41 | 25 | N.D. |
| 1066092 | 27 | 15 | 56 | 21 | 13 | 47 |
| 1066217 | 37 | 26 | 68 | 32 | 26 | 62 |
| 1066253 | 27 | 15 | 50 | 22 | 14 | 39 |
| 1066377 | 50 | 30 | 79 | 40 | 28 | 73 |

TABLE 115

Reduction of human UBE3A-ATS RNA in transgenic mice

| Compound ID | UBE3A-ATS RNA (% control) RTS4796 | | |
|---|---|---|---|
| | SPINAL CORD | HIPPOCAMPUS | CORTEX |
| PBS | 100 | 100 | 100 |
| 1263473 | 43 | 71 | 66 |
| 1263474 | 8 | 15 | 10 |
| 1263475 | 6 | 10 | 8 |
| 1263476 | 6 | 12 | 14 |
| 1263477 | 4 | 10 | 11 |
| 1263478 | 13 | 18 | 17 |
| 1263486 | 27 | 27 | 32 |
| 1263487 | 31 | 43 | 43 |
| 1263488 | 23 | 24 | 14 |
| 1263489 | 16 | 17 | 16 |
| 1263490 | 24 | 28 | 23 |
| 1263491 | 22 | 25 | 21 |
| 1263492 | 29 | 50 | 58 |
| 1263504 | 9 | 11 | 12 |
| 1263505 | 6 | 11 | 7 |
| 1263506 | 5 | 10 | 6 |
| 1263507 | 5 | 14 | 6 |
| 1263508 | 7 | 15 | 9 |
| 1263509 | 6 | 17 | 7 |
| 1263510 | 37 | 70 | 72 |
| 1263517 | 13 | 22 | 17 |
| 1263518 | 19 | 36 | 30 |
| 1263519 | 20 | 25 | 15 |
| 1263520 | 15 | 19 | 11 |
| 1263521 | 20 | 44 | 20 |
| 1263522 | 22 | 29 | 35 |
| 1263523 | 21 | 30 | 32 |
| 1263532 | 29 | 49 | 40 |
| 1263533 | 18 | 24 | 17 |
| 1263534 | 27 | 52 | 37 |
| 1263536 | 30 | 45 | 36 |
| 1263537 | 29 | 43 | 34 |
| 1263539 | 51 | 59 | 88 |
| 1263540 | 22* | 21* | 29* |
| 1263541 | 52 | 66 | 80 |
| 1263543 | 49 | 362 | 84 |
| 1263544 | 53 | 100 | 104 |
| 1263545 | 36 | 54 | 57 |
| 1263546 | 45 | 45 | 88 |
| 1263547 | 26 | 28 | 30 |
| 1263548 | 36 | 45 | 47 |
| 1263549 | 66 | 87 | 84 |
| 1263550 | 47 | 75 | 76 |
| 1263551 | 30 | 45 | 39 |
| 1263552 | 66 | 65 | 93 |
| 1263554 | 72 | 75 | 88 |
| 1263556 | 60 | 59 | 83 |
| 1263557 | 86 | 91 | 109 |
| 1263408 | 45 | 70 | 46 |
| 1263409 | 29 | 44 | 33 |
| 1263410 | 29 | 64 | 42 |
| 1263411 | 42 | 72 | 58 |
| 1263419 | 47 | 126 | 65 |
| 1263420 | 73 | 130 | 72 |
| 1263429 | 27 | 33 | 36 |
| 1263434 | 44 | 50 | 42 |
| 1263435 | 47 | 42 | 61 |
| 1263441 | 22 | 17 | 29 |
| 1263451 | 21 | 16 | 28 |
| 1263452 | 14 | 8 | 15 |
| 1263453 | 13 | 9 | 9 |

*Only 1 animal in group

TABLE 116

Reduction of human UBE3A-ATS RNA in transgenic mice

| Compound ID | UBE3A-ATS RNA (% control) | | |
|---|---|---|---|
| | SPINAL CORD | HIPPOCAMPUS | CORTEX |
| PBS | 100 | 100 | 100 |
| 1263454 | 6 | 8 | 13 |
| 1263455 | 5 | 19 | 35 |
| 1263458 | 39 | 62 | 88 |
| 1263459 | 28 | 45 | 52 |
| 1263460 | 11 | 28 | 34 |

TABLE 116-continued

Reduction of human UBE3A-ATS RNA in transgenic mice

| Compound ID | UBE3A-ATS RNA (% control) | | |
|---|---|---|---|
| | SPINAL CORD | HIPPOCAMPUS | CORTEX |
| 1263461 | 24 | 30 | 35 |
| 1263462 | 25 | 24 | 25 |
| 1263463 | 36 | 40 | 66 |
| 1263464 | 25 | 22 | 38 |
| 1263465 | 32 | 35 | 39 |
| 1065786 | 121 | 75 | 32 |
| 1165526 | 116 | 78 | 46 |
| 1272943 | 41 | 73 | 32 |
| 1272946 | 37 | 69 | 33 |
| 1272947 | 55 | 94 | 54 |
| 1272951 | 70 | 89 | 75 |
| 1272952 | 125 | 85 | 109 |
| 1272953 | 86 | 78 | 51 |
| 1272954 | 110 | 89 | 70 |
| 1272955 | 137 | 136 | 70 |
| 1272960 | 59 | 77 | 40 |
| 1272962 | 45 | 52 | 26 |
| 1272964 | 74 | 58 | 62 |
| 1272965 | 43 | 39 | 25 |
| 1272966 | 52 | 68 | 67 |
| 1272967 | 65 | 69 | 62 |
| 1272968 | 76 | 62 | 66 |
| 1272969 | 83 | 60 | 147 |
| 1272970 | 143 | 57 | 60 |
| 1272971 | 81 | 58 | 48 |
| 1272972 | 74 | 69 | 38 |
| 1272974 | 40 | 29 | 18 |
| 1272975 | 124 | 86 | 96 |
| 1272976 | 93 | 62 | 50 |
| 1272977 | 58 | 59 | 47 |
| 1272978 | 39 | 46 | 40 |
| 1272979 | 61 | 69 | 46 |
| 1272982 | 60 | 58 | 42 |
| 1272983 | 84 | 83 | 70 |
| 1272985 | 72 | 56 | 38 |
| 1272987 | 181 | 37 | 28 |
| 1272988 | 66 | 34 | 31 |
| 1272989 | 87 | 60 | 68 |
| 1272992 | 77 | 45 | 42 |
| 1272993 | 57 | 36 | 60 |
| 1272994 | 16 | 12 | 10 |
| 1272995 | 182 | 35 | 93 |
| 1272996 | 26 | 9 | 18 |
| 1272997 | 24 | 12 | 27 |
| 1272998 | 26 | 14 | 17 |
| 1273000 | 104 | 45 | 56 |
| 1273003 | 93 | 28 | 60 |
| 1273009 | 39 | 8 | 19 |
| 1273011 | 145 | 78 | 80 |
| 1273012 | 110 | 36 | 71 |
| 1273014 | 46 | 19 | 37 |
| 1273015 | 79 | 35 | 68 |
| 1273016 | 58 | 34 | 37 |
| 1273017 | 46 | 39 | 56 |
| 1273018 | 41 | 24 | 60 |
| 1273019 | 98 | 39 | 80 |
| 1273020 | 44 | 10 | 19 |
| 1273021 | 59 | 27 | 47 |
| 1273022 | 73 | 23 | 45 |
| 1273023 | 54 | 23 | 31 |
| 1273024 | 29 | 21 | 25 |
| 1273028 | 46 | 50 | 28 |
| 1273031 | 45 | 17 | 28 |
| 1273032 | 40 | 21 | 35 |
| 1273033 | 36 | 12 | 26 |
| 699781 | 66 | 25 | 37 |
| 1065707 | 78 | 44 | 70 |
| 1165621 | 107 | 41 | 71 |

TABLE 117

Reduction of human UBE3A-ATS RNA in transgenic mice

| Compound ID | UBE3A-ATS RNA (% control) | |
|---|---|---|
| | SPINAL CORD | HIPPOCAMPUS |
| PBS | 100 | 100 |
| 1273034 | 25 | 23 |
| 1273035 | 16 | 20 |
| 1273036 | 24 | 26 |
| 1273061 | 33 | 22 |
| 1273062 | 28 | 10 |
| 1273063 | 32 | 29 |
| 1273064 | 38 | 25 |
| 1273065 | 27 | 16 |
| 1273066 | 34 | 36 |
| 1273067 | 44 | 42 |
| 1273070 | 25 | 23 |
| 1273071 | 57 | 71 |
| 1273072 | 38 | 48 |
| 1273037 | 12 | 25 |
| 1273038 | 16 | 29 |
| 1273039 | 15 | 29 |
| 1273040 | 39 | 33 |
| 1273041 | 48 | 29 |
| 1273042 | 51 | 17 |
| 1273044 | 45 | 27 |
| 1273045 | 48 | 24 |
| 1273048 | 30 | 18 |
| 1273049 | 19 | 15 |
| 1273050 | 30 | 31 |
| 1273051 | 17 | 21 |
| 1273052 | 14 | 15 |
| 1273055 | 14 | 20 |
| 1273056 | 16 | 22 |
| 1273057 | 16 | 18 |
| 1273058 | 20 | 22 |
| 1273059 | 16 | 17 |
| 1273060 | 36 | 35 |
| 1273084 | 41 | 35 |
| 1273087 | 12 | 14 |
| 1273088 | 33 | 28 |
| 1273090 | 24 | 41 |
| 1273091 | 26 | 31 |
| 1273092 | 37 | 38 |
| 1273093 | 28 | 23 |
| 1273098 | 17 | 23 |
| 1273099 | 14 | 10 |
| 1273101 | 29 | 32 |
| 1273102 | 20 | 18 |
| 1273103 | 12 | 5 |
| 1273104 | 57 | 16 |
| 1273105 | 34 | 9 |
| 1273106 | 30 | 11 |
| 1273107 | 24 | 8 |
| 1273108 | 31 | 13 |
| 1273109 | 30 | 13 |
| 1273110 | 37 | 8 |
| 1273111 | 46 | 12 |
| 1273113 | 25 | 10 |
| 1273114 | 46 | 26 |
| 1273115 | 15 | 7 |
| 1165523 | 38 | 17 |
| 1165533 | 31 | 19 |
| 1165538 | 64 | 25 |
| 1165550 | 47 | 11 |
| 1165563 | 30 | 12 |
| 1165586 | 35 | 19 |
| 1165596 | 69 | 49 |
| 1165616 | 109 | 25 |
| 1165855 | 49 | 16 |
| 1165897 | 39 | 28 |
| 1179808 | 83 | 36 |
| 1179841 | 22 | 9 |
| 1179843 | 22 | 11 |

Example 14

Activity of Modified Oligonucleotides Complementary to Human UBE3A-ATS in Transgenic Mice, Multiple Doses Modified oligonucleotides described above were tested in the UBE3A-ATS BAC transgenic mouse model RP11-748 line.

Treatment

The UBE3A-ATS transgenic mice were divided into groups of 3 mice each. Each mouse received a single ICV bolus of 10, 30, 100, 300, or 700 μg of modified oligonucleotide, and sacrificed two weeks later. A group of 8 mice received PBS as a negative control.

RNA Analysis

After two weeks, mice were sacrificed, and RNA was extracted from cortical brain tissue, hippocampal brain tissue, and spinal cords for real-time PCR analysis of measurement of RNA expression of UBE3A-ATS using primer probe set RTS40595 (forward sequence TCCTTCCC-TACCTTAGTCTTGA, designated herein as SEQ ID NO: 14; reverse sequence CCCTCTTGAACCAGGAAACA, designated herein as SEQ ID NO: 15; probe sequence AGATGGCAGCCCACATTTCTACTGT, designated herein as SEQ ID NO: 16). Results are presented as percent change of RNA, relative to PBS control, normalized to mouse GAPDH (measured by primer-probe set RTS108).

As shown in the table below, treatment with modified oligonucleotides resulted in dose-dependent reduction of UBE3A-ATS RNA in comparison to the PBS control.

TABLE 118

Dose-dependent percent reduction of human UBE3A-ATS RNA in transgenic mice

| Compound ID | Dose (μg) | Cortex UBE3A-ATS RNA (% control) | ED50 (μg) | Hippocampus UBE3A-ATS RNA (% control) | ED50 (μg) | Spinal Cord UBE3A-ATS RNA (% control) | ED50 (μg) |
|---|---|---|---|---|---|---|---|
| PBS | 0 | 100 | — | 100 | — | 100 | — |
| 749860 | 10 | 98.16531 | 138 | 81.99485 | 109 | 59.65406 | 17 |
|  | 30 | 84.95562 |  | 91.16468 |  | 45.18495 |  |
|  | 100 | 67.32992 |  | 52.07824 |  | 25.79271 |  |
|  | 300 | 26.23195 |  | 33.3197 |  | 10.36557 |  |
|  | 700 | 11.97921 |  | 16.72183 |  | 9.517061 |  |
| 1065645 | 10 | 90.14288 | 74 | 88.23692 | 71 | 37.14751 | 6 |
|  | 30 | 72.43123 |  | 66.81222 |  | 16.11173 |  |
|  | 100 | 49.12943 |  | 51.83015 |  | 10.87515 |  |
|  | 300 | 16.34235 |  | 25.55912 |  | 7.843655 |  |
| 1263461 | 10 | 88.27412 | 94 | 86.23292 | 126 | 60.06681 | 14 |
|  | 30 | 81.19946 |  | 84.36883 |  | 33.7366 |  |
|  | 100 | 55.94376 |  | 68.69458 |  | 21.85816 |  |
|  | 300 | 16.25568 |  | 23.08811 |  | 28.43356 |  |
|  | 700 | 11.55421 |  | 20.98394 |  | 18.26012 |  |
| 1263486 | 10 | 84.88829 | 91 | 88.16814 | 110 | 80.05438 | 49 |
|  | 30 | 73.65319 |  | 88.23227 |  | 67.24883 |  |
|  | 100 | 53.51549 |  | 46.18175 |  | 35.76668 |  |
|  | 300 | 29.17494 |  | 39.41106 |  | 25.80888 |  |
|  | 700 | 13.16333 |  | 21.58236 |  | 14.67831 |  |
| 1263517 | 10 | 61.99356 | 27 | 78.62965 | 38 | 28.43223 | 5 |
|  | 30 | 57.35782 |  | 64.77742 |  | 4.093424 |  |
|  | 100 | 28.22543 |  | 31.27599 |  | 3.855931 |  |
|  | 300 | 13.48909 |  | 11.49965 |  | 2.253222 |  |
|  | 700 | 6.218008 |  | 9.114471 |  | 0.845911 |  |
| 1263518 | 10 | 83.49507 | 47 | 74.9207 | 36 | 7.813722 | N.C. |
|  | 30 | 63.00462 |  | 58.90944 |  | 6.925703 |  |
|  | 100 | 36.83505 |  | 35.79351 |  | 9.984906 |  |
|  | 300 | 10.60636 |  | 16.33499 |  | 22.15675 |  |
| 1263532 | 10 | 87.76102 | 437 | 104.2908 | 508 | 85.92361 | 126 |
|  | 30 | 93.21178 |  | 107.4279 |  | 86.97925 |  |
|  | 100 | 82.08274 |  | 79.80543 |  | 56.10128 |  |
|  | 300 | 63.11973 |  | 71.02516 |  | 37.9068 |  |
| 1263533 | 10 | 85.64712 | 62 | 91.08657 | 93 | 79.33594 | 35 |
|  | 30 | 74.82061 |  | 92.99996 |  | 56.07265 |  |
|  | 100 | 37.83251 |  | 50.48182 |  | 32.95345 |  |
|  | 300 | 17.85169 |  | 15.11169 |  | 16.13775 |  |
|  | 700 | 13.22447 |  | 16.26845 |  | 14.77717 |  |
| 1263537 | 10 | 99.27557 | 167 | 101.6452 | 149 | 58.69295 | 32 |
|  | 30 | 61.11154 |  | 67.12889 |  | 57.56289 |  |
|  | 100 | 70.65222 |  | 60.23925 |  | 35.5374 |  |
|  | 300 | 35.35647 |  | 38.67746 |  | 31.30235 |  |
|  | 700 | 37.55784 |  | 42.24916 |  | 26.47357 |  |
| 1272944 | 10 | 85.26636 | 171 | 98.97738 | 241 | 86.06921 | 66 |
|  | 30 | 83.3624 |  | 91.08809 |  | 60.22092 |  |
|  | 100 | 64.40395 |  | 69.68625 |  | 45.39798 |  |
|  | 300 | 47.00232 |  | 54.90247 |  | 34.02307 |  |
|  | 700 | 18.19851 |  | 26.34956 |  | 26.27892 |  |
| 1273033 | 10 | 92.81903 | 159 | 104.9703 | 202 | 71.92708 | 27 |
|  | 30 | 86.45458 |  | 92.23621 |  | 47.44761 |  |
|  | 100 | 71.94214 |  | 74.17289 |  | 34.27954 |  |

TABLE 118-continued

Dose-dependent percent reduction of human UBE3A-ATS RNA in transgenic mice

| Compound ID | Dose (μg) | Cortex UBE3A-ATS RNA (% control) | ED50 (μg) | Hippocampus UBE3A-ATS RNA (% control) | ED50 (μg) | Spinal Cord UBE3A-ATS RNA (% control) | ED50 (μg) |
|---|---|---|---|---|---|---|---|
| | 300 | 28.94805 | | 34.12991 | | 17.19729 | |
| | 700 | 19.14991 | | 35.15452 | | 16.60517 | |
| 1273039 | 10 | 84.62214 | 63 | 93.89685 | 77 | 52.24285 | 33 |
| | 30 | 70.19074 | | 70.45983 | | 45.93645 | |
| | 100 | 40.06878 | | 45.44749 | | 30.60229 | |
| | 300 | 22.18407 | | 28.77613 | | 27.68067 | |
| | 700 | 16.46246 | | 23.35814 | | 20.2156 | |
| 1273050 | 10 | 60.65157 | 34 | 76.1426 | 178 | 108.4293 | 45 |
| | 30 | 46.72804 | | 76.65907 | | 59.53868 | |
| | 100 | 42.13233 | | 63.21802 | | 30.24442 | |
| | 300 | 35.42049 | | 42.84989 | | 16.76795 | |
| | 700 | 27.88596 | | 44.42969 | | 16.65603 | |
| 1273055 | 10 | 54.09476 | 104 | 101.4753 | 139 | 95.64317 | 46 |
| | 30 | 75.60993 | | 80.40454 | | 46.396 | |
| | 100 | 62.55598 | | 61.10855 | | 43.64926 | |
| | 300 | 37.44794 | | 36.83808 | | 26.42752 | |
| | 700 | 18.68964 | | 24.28962 | | 17.02671 | |
| 1273062 | 10 | 83.90397 | 65 | 91.25815 | 65 | 96.79799 | 85 |
| | 30 | 71.94265 | | 68.4521 | | 78.51707 | |
| | 100 | 41.74674 | | 43.10219 | | 45.07505 | |
| | 300 | 23.62598 | | 26.78065 | | 25.9929 | |
| | 700 | 8.048482 | | 17.65158 | | 20.9903 | |
| 1273090 | 10 | 51.37967 | 25 | 83.05922 | 143 | 94.48769 | 120 |
| | 30 | 53.46583 | | 70.46917 | | 79.90936 | |
| | 100 | 41.09529 | | 69.46586 | | 53.85753 | |
| | 300 | 25.47022 | | 49.33954 | | 51.06804 | |
| 1273091 | 10 | 48.66948 | 28 | 86.34518 | 195 | 126.1334 | 240 |
| | 30 | 49.31716 | | 78.33165 | | 118.9585 | |
| | 100 | 48.19272 | | 67.14459 | | 75.20145 | |
| | 300 | 31.19941 | | 48.97407 | | 42.91308 | |
| | 700 | 28.63277 | | 34.46767 | | 43.51426 | |

Example 15

Tolerability of Modified Oligonucleotides Complementary to Human UBE3A-ATS in Wild-Type Mice, 3 Hour and 2 Week Study Modified oligonucleotides closely matched to LNA/DNA oligonucleotides described in WO2017/081223 were tested in female wild-type C57/B16 mice to assess the tolerability of the oligonucleotides. See, Certain Comparator Compouonds, hereinabove. Wild-type female C57/B16 mice each received a single ICV dose of 700 μg of modified oligonucleotide listed in the table below. Each treatment group consisted of 4 mice. A group of 4 mice received PBS as a negative control for the experiment. At 3 hours post-injection and 2 weeks post-injection, mice were evaluated according to seven different criteria. The criteria are (1) the mouse was bright, alert, and responsive; (2) the mouse was standing or hunched without stimuli; (3) the mouse showed any movement without stimuli; (4) the mouse demonstrated forward movement after it was lifted; (5) the mouse demonstrated any movement after it was lifted; (6) the mouse responded to tail pinching; (7) regular breathing. For each of the 7 criteria, a mouse was given a subscore of 0 if it met the criteria and 1 if it did not (the functional observational battery score or FOB). After all 7 criteria were evaluated, the scores were summed for each mouse and averaged within each treatment group. The results are presented in the table below.

TABLE 119

| | | | | | | |
|---|---|---|---|---|---|---|
| Compound ID | 3 hr FOB | 2 week FOB | SEQ ID NO: 1 Start Site | SEQ ID NO: 1 Stop Site | Chemistry Notation (5' to 3') | SEQ ID NO |
| PBS | 0.0 | 0.0 | | | | |
| 1219022 | 7.0 | n.d. | 468275 | 468294 | $A_{ls}A_{ls}A_{ds}T_{ds}T_{ls}A_{ds}T_{ls}T_{ds}T_{ds}A_{ds}T_{ds}A_{ds}{}^mC_{ds}A_{ds}{}^mC_{ds}{}^mC_{ds}A_{ls}T_{ls}{}^mC_{ls}A_{l}$ | 2905 |
| 1219023 | 1.0 | 3.5 | 462549 | 462566 | $T_{ls}T_{ls}T_{ls}A_{ds}T_{ds}{}^mC_{ls}A_{ds}A_{ds}T_{ds}A_{ds}T_{ds}{}^mC_{ds}T_{dsds}T{}^mC_{ds}T_{ls}{}^mC_{ls}A_{l}$ | 2906 |

TABLE 119-continued

Tolerability scores in mice at 700 µg dose

| Compound ID | 3 hr FOB | 2 week FOB | SEQ ID NO: 1 Start Site | SEQ ID NO: 1 Stop Site | Chemistry Notation (5' to 3') | SEQ ID NO |
|---|---|---|---|---|---|---|
| 1219024 | 5.3 | 6.5 | 471876 | 471894 | $G_{ls}{}^mC_{ds}A_{ls}{}^mC_{ds}A_{ls}T_{ds}T_{ds}{}^mC_{ds}T_{ds}T_{ds}T_{ds}{}^mC_{ds}T_{ds}A_{ds}T_{ds}A_{ds}{}^mC_{ds}{}^mC_{ls}T_1$ | 2907 |
| 1219025 | 4.0 | 6.0 | 461987 | 462003 | $T_{ls}T_{ls}A_{ds}T_{ls}A_{ls}Gds{}^mC_{ds}{}^mC_{ds}A_{ds}T_{ds}T_{ds}{}^mC_{ds}T_{ds}A_{ds}T_{ds}{}^mC_{ls}T_1$ | 2908 |
| 1219026 | 1.0 | 6.0 | 487371 | 487387 | ${}^mC_{ls}T_{ds}{}^mC_{ls}A_{ls}A_{ls}A_{ds}GdsA_{ds}T_{ds}{}^mC_{ds}A_{ds}T_{ds}T_{ds}{}^mC_{ls}T_{ls}{}^mC_{ls}A_1$ | 2909 |
| 1219027 | 1.0 | 0.0 | 487430 | 487449 | $T_{ls}T_{ds}A_{ls}{}^mC_{ds}A_{ls}{}^mC_{ds}T_{ls}T_{ds}A_{ds}A_{ds}T_{ds}T_{ds}A_{ds}T_{ds}A_{ds}{}^mC_{ds}T_{ls}T_{ds}{}^mC_{ls}{}^mC_1$ | 2910 |
| 1219028 | 6.0 | 6.0 | 496570 | 496587 | $G_{ls}T_{ds}T_{ds}T_{ds}{}^mC_{ds}{}^mC_{ds}A_{ds}T_{ds}{}^mC_{ds}T_{ds}A_{ds}{}^mC_{ds}T_{ls}A_{ls}T_{ls}A_{ls}A_1$ | 2911 |
| 1219029 | 6.3 | 6.0 | 503154 | 503170 | ${}^mC_{ls}T_{ls}G_{ds}T_{ds}A_{ls}T_{ds}A_{ds}{}^mC_{ds}A_{ds}{}^mC_{ds}{}^mC_{ds}A_{ds}T_{ds}{}^mC_{ds}{}^mC_{ds}{}^mC_{ls}A_1$ | 2912 |
| 1219030 | 5.0 | 5.0 | 487478 | 487494 | $A_{ls}G_{ds}T_{ds}T_{ls}{}^mC_{ls}T_{ds}A_{ds}{}^mC_{ds}T_{ds}A_{ds}T_{ds}A_{ds}{}^mC_{ds}T_{ls}T_{ls}T_{ls}{}^mC_1$ | 2913 |
| 1219031 | 5.3 | 6.0 | 464879 | 464898 | $T_{ls}A_{ls}T_{ds}A_{ds}{}^mC_{ls}T_{ds}T_{ls}T_{ds}T_{ds}{}^mC_{ds}T_{ds}T_{ds}T_{ds}A_{ds}A_{ds}{}^mC_{ds}{}^mC_{ds}{}^mC_{ds}T_{ls}T_1$ | 2914 |

A subscript "l" indicates a 4'-2' LNA modified sugar moiety, a subscript "d" indicates a 2'-β-D-deoxyribosyl sugar moiety, a subscript "s" indicates a phosphorothioate internucleoside linkage, and a superscript "m" before a C indicates 5-methyl cytosine.
n.d. means no data; not tested.

Example 16

Tolerability of Modified Oligonucleotides Complementary to Human UBE3A-ATS in Rats, 8 Week Study Modified oligonucleotides described above were tested in rats to assess the tolerability of the oligonucleotides. Groups of male, 6-8 week old Sprague Dawley rats each received a single intrathecal (IT) dose of 3 mg of oligonucleotide as listed in the table below. Each treatment group consisted of 4 rats, approximately matched for starting weights. A group of four rats received PBS as a negative control. The rats were weighed before dosing, and were weighed again at 8 weeks post-dose. Rats are expected to gain weight over the course of the study due to growth; too little weight gain is a sign of compound toxicity. Absolute values of body weight change were normalized to the body weight change observed in PBS-treated groups to allow comparison between two studies with different average starting weights for the rats, with the body weight change of the PBS group set to 100%. Statistical significance (p-value) of the change in body weight compared to the PBS-treated group was calculated by a two-tailed Welch's T-test in Excel (two sample, unequal variance). A p-value of <0.05 indicates that there is less than a 5% chance that the observed differences are due to random sampling errors.

TABLE 120

Body Weight Change in Rats at 8 weeks post-dose

| Compound ID | B.W. change as % PBS | p-value |
|---|---|---|
| PBS | 100 | n/a |
| 1219027 | 87 | 0.03 |
| 1065645 | 101 | 0.83 |
| 1263517 | 100 | 0.91 |
| 1263518 | 103 | 0.50 |
| 1263533 | 100 | 0.99 |
| 1273039 | 105 | 0.26 |
| 1273062 | 100 | 0.98 |

SEQUENCE LISTING (2916 sequences)

SEQ ID NO: 1 - DNA, 619382 bp, Homo sapiens
ttatatgaatgcacatgaacctgtcctagaaaccttccattgacaccttcttttaatgtcatcaacacaaaacttgcagaggagctgtcagcaggttggaaagataatctcacagagtgttgcgtaggaatctcacaagaaatgaaatatcaccaaagcttctggttaacagagaagatgataatgaggagaaaatcataagaaagatgaatagtgactcagaagaggtgcatctggatgagagaaatttatcaatatctttatttttctattttttgagacagagtcttgctctgtcacccaagctggagtgcagtggcacaatctcggtccactgcaacttccatctcccgggttcaagcaattcttctgcctcagtctcccaagtagctgggattacaggcacacactaccacaccgggcaaatttttgtatttttagtagagaattttttttttttttttttttgagatggagtctcactctgttgctgaggctggagtgcagtggcacaatctcggctcactgcaagctccgcctcccaggttcacgccattctcctgcctcagcctcctgagtagctgaggggactacaggcacctgccaccacacctggctaattttttgtatttttagtagagatggggtttcaccgtgttagccaggatggtctcgatctcctgacctcaggatcctcccgcctcggcctcccaaagtgctgggattacaagtgtgagccaccgcgccgagcagcaataccttttttaacgtgatttgcttatatttgcatctcattggagtgatataaaacaaatatccacatttatatatgtcgaaaagagttattgtcattaattgtgaggtaaaaattataaggtgtaggaagtatttgtaccatatcttgtcaatgattttattcctttactatggcgtaaaataatgatgtattttacaattgatacaaaaaatatatttaaattacttagaaaacactgtcaatattagcatactgatgttgtgattagtatagacctgatatttatctacaggcattatgtatcattagttcattcatttctcccaaaatatcaaaaggtaggttctattaccactcctaagtacaagttctgaatttgagctaaagccctgcaaaaaaagggctgtctccatagtccttgctcacataaactatgttagaaaatgtttttctgttaaattgtgaatacattgtaggtctaatttaataaatcttatgctagcctatagtcatgaagatattttcctaacataggttgtaaatactgtattaaaaggtatttatatttgggtctatgatgcacctgcaattaattttatgtgtaatgtgaagttaaaggtacatttaacttcccccaatgaacattaatttcctagaacattgattgtaaaagccatctttctactaataactgctcttattaattatttgcatttatattattttgtctgttttgagctttcctttatttcattggttcacctttctatctgtgcaaatattacattgtcttaattactaagagtcttcatttaatacaagaattttccatccacagccctttagcctatctactgtggtgttctaaaaggaagaaagaggctagtaaatcctggatactttgctcctacaccaatattcccagctgtaccttgaaataaaaggatttagaactttagaacattgctgttgttgcttatgtctctaatgttctcttgaatcttgacaatccccgaacactgctccccgctttatttgtttagtccagtcccagtgaaataaattagatgtcaaggctcctcattatggttgcctggtttttggaacctggggtactttgtactcctccagcaacagccagaggtggcagagagctgtcagtcatccctgggtgcctcctgcgcaagcgcagttgtcctcctgcgccgacctcgaatgcggtcctcctgctgcagaccacgcccaccaagggctggccgcagccactgtagctgagctcagagccttctgtgtggtttgcgggggcaaggtcagctgccccctgccctctctctggggctatttgaggaatgcggcctttttgcataagaaaggcttttctctacagtaactgtggtcgctgatcaatgacaccttcctggtaacatttcatattgcttttttggaggtgggggtgcagatatctttaaaacttgcatgcgattgtctttcttttaatcacataaacatcatttaaaaccaattcatattttgtattgtatattaatgcctttcattcctgtattttaaaatgctatcataatcatttttcgaaatacatatttaattattttcatctgttcaatcatctttctttagtaattaaatgaaaatagcactttattaagaaagacaaatgttacatattctctgttttagtgttttccagaaatttgctatgaaatacgactggttgaaaaggagagggtcagagactttcctgagagccacaggacaaaatttacttacaatcgcaggcttaaagaagctatgatagtttaaattacgtggcttagtttgttcttattgtggaaggtgcacaaggaattaatttgtgtagacagaacactgagagtcccattctgaatgcagagacagctactttgctaccgtgcaaatgagtgtcgtcatattgtttgtttttctccttacccaaaagctatagacattggcttgcatatttgagtattttcactttggttttgtaaatggctgcttgacttgccttcctacagaaaatccataatacagagatgtattattttcttactcctttatgagtgattagtttgcactgaaataaaaatgccactcaggaaatgtcatacatcttcaagcagcatatattttaatagtatcatcttgtagaaagggaattacaatctttatttcttctatatcaatgagcaaactacttttttaatttttatatgttcatttttattgacttagtcaatagtttacctactttttaggttttacgtgctccattaatgtccattgttttaggctgaacctttgacactcctcatatatcgtttgtatgagactagatggcaagtaaagataggattcctcaccctaggttaaacactaacttcctcttgaagaaacaacttaggagtccaaaaagcaggctaggaattgtttaggttctgcaatacgaattgtgcaaatgccaacaggattgaattgagagaaacacattctctaatgaaggactcattcctgcagggtggatctatgagattcaatagcaaatggctgttatacaagtaatgaaatcctcaatcttatggtctaaaagcgattctggggggcacttatttaagatacatgagatgtgaaaaagcaatggaccaagagcattgatagtttatggatatttttatttcacattattgatagagctttgtttgccaggcaatgctgcagtcaggcactcggggtttcaataccctatacagaaaatctcaagagcagaccttggttaatttttttaagtaaccctcatcttcattcttttattgtattatgacctcgcgccattgaccttaaatttcactacaaatttagaagaacctaatagtcattgcaaactagatagataatggtatttatgtaatgaaggacaagggaaagatgattcccaaatctgaaagaaactagaagttttctggggaaacaaatagaggagataagatttactggtttattcttcattgatgagagttgcgttctgttctgataaatggaaagctccattgaaattacagatggtcctcaacttaagttggggctacttcccaataaaccatattgaaaatggtttcataaattgaaaatatcaccataaattgaaatatcataaattgaaaatatcaccagtcaaaatgtgtttaacatgcctaccttactgaacatcatactttagtctagcctgtcttaagagtgctcagaacacttatatttgcctacatttgtacaaaatcatctaacagaaaccatattttataatgtgttaaatatctcatgtaacttattgaatactgcaatgaaaatgaaaagcagaatggttgtatgggtactcgaagtacaatttctactgaatgtgtattgctttctcacaattataaagttgggaaatctgaagtcatacctcagggagtgcttttattacacaatacaggtttatcagacgcatataccaacaaatcataggaaattcaggtttgggtcaagggggaggggttcaacctacttatacatatttccttcctctctgttgggctacctttatccttgggattgttgcaagatggccgtgtcatgtaaagggctgtgtcttttagcatcatgaataagatgaaagagttgaaggccaacttcattcaaatgtcttctcgatgtgtccttccctttttctcctggactgctctgtgatccatgtctctgtagaaaatggctggcataagtcaatttctgactgggagctgtcatgattactgtctcccactgttaacactgtacttggaggtcttgatggaattgggcaaacctgttctttcagaccctcagtttcatctcaacacaaaactctccaaaagtccttgctgctccacagcagggaactctcttgaagcaataacatgaggaaatagtgggcttgcatggctgcctcacattcctcaggtatcactgtgctcattgcctgatgtactgtgtcttgccaaccatcattccacgtaatttacccattcttggtttttacattggttaaggcatgtacaaaccctgttagtttttctgcagtatttggattcataccttctgaaattacttgacgattactgtgtctctggttatttgcttctagttggcaatacaaaggaacaatgtgaatgaaactcataaagaaaaacctatgatttaatgggcgtgtgtaacactagagggaaggtcagagttagtctatgcatgggtataggtaggagtctcagtgggtgtcagccattctgtgtcaacaaatcaaatatttaaggtggatctaaaagaaaggtaatatctctgccaattaaactagagtcacgcattgactaatggcaaatacagtctaagaagtgcatttttaggcaattttgtcattatgagaacaacgtagagagtacttacacaaacttagatggtatagcctactacatggctaggctatatggtaaagcatgttgcttctaggctacaaacctttactgaactgtaagcaatgataacacgatggtgtcatatcccatatatatacacatacacacacatacatatatatacatatactatagtaaaaatatgatataaaacattttttaactggtactgctgtttaaagcagatatcatgagtggattttgcaggaccggaagttcatccaggtgagtgagtgagtgagttgtgagtgaaggtgaaggtctagggcattattgtacactactgtagatttaagaaacactgtatgcagccgggcgcggtggctcacgcctgtaatcccagcactttgggaggccgaggcaggcggatcacgaggtcaggagattgagaccatcctggctaacacggtgaaacaccgtctctactaaaaatacaaaaaagttagtcgggtgcggtggcgggcgcctgtagtcccagcatactcaggaggctgaggcgggagaatggggtgaacctgggaggcagagcttccagtgagctgagatcgcgccactgcactctggcctgggtgaaagagcgagactctgtctcaaaaaaaaaaaaaaaaaaaagaaacactgtatgcttacgctatactaaatttattttaaaaacctgaagtaggccaggcgcagtagctcacgtctgtaatcccagcactttgggaggttgaggcaggaggatcacgaggtcaggagttcgagaccagcctgaccaagatggtgaaaccctgtctctactaaaaatacaaaaattagccgggcattgtggcacatgcctgtaatcccagctactcaggaggctgaggcaggagaatcacttgaacccaggaggcagaggttacagtgagccaagactgcaccactgcactccagactgggtgacaaagcgagactccatctcaaaaaaaaaaaaaaaatcctgaaatactaatgacattatgattgctacaatgtcacaagataagataaattttcaactccattgcaatcttatgggaccagcaacgtgcatattgtctgttgttgaccaaaacggcccttatgtggtacatgaccctatacacataacagcatattttatatttatggaaaaagcccttctagaattataaaatcacaagttttactcacataaaatttaacacaatattgagattaactcataaatgaaattataaaagtcttaaaattttgactatgatagttctaaacaagattttaatccagagaaatgaatgtgttcacgtaatcctctgtggcataaagagtaatggcaatgaaacatttcttaataaaacaggctgcatcattgtcagtgcgatttgcaccttcccgttgacatccattctgtaggtattgaatgcaggtgatcttacctgaaggtgacaacagaagattttattacaagatcacgcatgtgccctcaataacgccatgtcattgatgccaccagggtaacagctattgtgataaaatttgaaaaataaacatatgtggcttgaacccgggaggcggagcttgctgtgagctgagatcgcgccactgcactccagcctgggcgacagagcgagactccgtctcgaaaaaaacaagaaagaaaaaagaaagaaaaataaacatacgctaaaaatttagaaggatagtaagtaataagcatttgattgcttgagcccaggaattggaggctgctatgctctgtgatcacaactatgaatatccattgcactgcagcctgagaaatatagctaggctccatctctaaaaaagtaaataactaaataagtgtttgaaaatatttagcaaggaagccatactaatgtagctgaatcttggaaatcaagaaaaaaaattgttcgtttaaaagggcaaaattaaaaaattctttccagatagaaagaataggtgcagatgatagagcagcgtggcccaggggaggggctaagcagtggactaaggatggggaggctggagaagaggctgaggggagtcacatgttgtcctgagatgagaaagggaaaaaaagaaacatgttcatcttcaagtgcaaactctcttcagattgaaagaaagtttttagtttcttgggaagcagaaaagaatataggtgaggagtttgagagattcattaatttctttgtgaaattcaacataaaggaagatattctgtgttgctctttgttcactatatgtgtggggctcacagggaagcaatatagacaaagtttccaaattctcagatgttaaaggccaatggggattcagaaaacgcaacagaaactaaactgcaagtggaagagctgcccttgggagcccagagggcaagtttcaggcctggactgggtgggcaagggaggcctccaggaggaggagctttggaggagattgtggagagtgaggagcagtgagtccagcaaacagggcagggaaagcgaggaggaaacagtgtgtctgtggcacaggccagggcatgagaagagggtggtgggttggaaggaccactgggatgagtaatacatgaggaggcaggagaaggaagggcagaccatgcagggactgggcatgggggtgagggtgccgggcagctcagaaagtgatgcaggggccgctctctgaggactgcattctgtggggagggatttgaatgtctcagttcttttatgaaatgttatccccaatccatgaggtcttctgattcaggaaccagtcagaacaggtgagggtggccccagtccactgtgcaggaccattagcattgccaggaggggttggtgctgaggacaaaagagagtgaaaaggggcaaagaactttctttcctgtctgtcattttgcagatgtaagtgggatctgtggatctgaaaattcacagtggccagctcaccaccacctgatgaaagatacaccacagggtgagagcatcctaacagcaaactgcaaatgaggtgggtttgcagctgcacagagaagggaccccagggaagctacacgggcaaggcaggcaggggacttcagaggtggtagcagtgggtgttgatgaaattattctctgaggatatacacgtttgtcagtgtacgtgcatgaccgcttacatgttgatgttcgcatacaaaccccacaattttctcatgtttttcagagcatagcatgtattttgactttattctttctaccacacgtaaccatgccttgtatacctagcaatacttaacgtttatttttggtggattattcatggttaatgcatttcctgacttggtagccaaatgaaattaccttgctttacaggcctttggttgatcatttctgaagatttgtgtcgcctgaattcagtgggggtcacctctccatgatcttaagcaacagtcctgttgggactgttatgctatcctacttaactttggacttgtatgtcctggaaaatatgaaactatcgatactcacttgaaaattccaggtgctttaccttttactttgtttttgccgtgtttccaatgttatatattttctcccacttactttggattcaattgctctgcttccttttacagtaaaaatttagatgtttgaattttgggtttcaacttttctaatatatacacactcaatgctgtaattttcctctaagcttccctgttgtagctgacaaattttgatgaggtgtgttttcctttcaatttagttcaaattattttaaaaaatttctcttgagatttctttgacccatgtattatttggaaatgaattatataatctccacgtattttgcaattcaccagtttttaaaaattgatttctagcttaattctgttgtgttttgagtgcatacattgtattagtctgattcttttaaatggtttcaggtgtgttttatggaggagaatgtggtgcatctcgatgagtggtcctgtgggcttgagttcaatgtgtattctgcccgttgttggataaagtctgtagatgtcaattatatccaattgactgatgatactgttgagttcaactatgtccttactgattttttctgcttggtggatctgtctatttctgatagaggagtgttgaaagtctccaacgataatagcggattcatctatttcttattgtggttttaacagtttctgcctcacgtagactgatgccctgttgctctgttgttacatgcatatatattaaggatcattatattttcttggaaaatcgatccctttattatcacataaggtctttatccctgataattttcctgtatttacattacattctttctgaagctaataaagctatgcctgctttcttctggttactgttagcaaggtacattttgtttcattcatttacttttatatgtacttttactttttttacatttactcttattaattgacaaaatttgaggtattgactatgtaaaatcttcacatcatcttcaaacatgatgtttgaagaataatatatattgtgaagtgaaaaattcttgctaagaacatatgtgttacctcacacagttatttttcgtggcaagaacactttacatccactctttcttcatttttcataatgcaatttattgttaactatagttaccatgttgtacaatctcttgatctttttcttcctatctaactgaaattttgtacccattcacaatcatctacccatcctcatcccctaccacccttaggccctagtactcaccattctactttgtatttatataaatgagcttttttagattccgcttacacatgggttcatgtggtatttgtctttctcttcccggcatatttcatttaacatattgtcatgcagatacattcattctgcctccaatgacagtaattctccctttttaaggccgataatatcctgttttgcatatacactgcattctttttatccattaatctgttgatgggcacttaggttgatcccatatttggctattgtgactaattctggaatgaatgtgggagtgcagatatctatccaacacaccggatagtcaatgaaatctcccaaggcagattttattacctttggatatatacccagtaataagactgctcgatcaaagggtaattctattgtttttttttttaggatccttcacaatttttcccataattactatattgtactaatttacattcccaccgacagtacacatgttcccttttctccctatctttatcaacactaacttttgtcttttaaaatagccattctaacaagtgtgagatgatatctcattgatttaaatttgcaattgtctatgtatgtcttcatatttatacagatttccaatatacaagatataacggggacttgtttttagatctactctgacaatgtgtctttaattggtgcatttcaaccattgctactcaaagggattactgacatggttgtgagaggtgaggccagctggacttcctgggtcgagtggggacttggggaaatctcctgtcttacagaggattttaaaatgcactaatcagcgctctgtaaaatgcaccagtcagcaggattctaaaagtagccaattgaggggaggattgaaaaaagggcactctgataggacagaaatggaacatgggtggggacaataaaggaattaaagctggtaaccccagccagcagccacaatccgctggggtccctttccacgcaatggaaggtttgtctcttcgctcttcacaataagccttgctaccggtcactctttgggtccatggcatcttggactaagagtccaaggtcagttcaacttggtggagcaagctggcagttagatgaaaaatatacacagacttgctgcagctgtacagatgatgaacgtagaactcaaaagatgatggaggccgggcgcggtggctcagggcctgtaatcccagcactttgggaggccgaggcgggcggaccacgaggtcaggagatcgaggccatcctggctaacacggtgaaaccccgtctctactaaaaatacaaaaattagccaggcgtggtggcaggcgcctgcagtcccagctactcgggaggctgaggcaggagaatggcatgaacccgggaggcggagcttgcagtgagccaagattgcaccactgcattccagcctgggcgacagagcgagactctgtctcaaaaaaaaaaaaaaaaaaaaaaaaaaagatgatggaaacagagtagaaatgatgagaatgatgaatgatgcctggagcttggttcctgggttgctgtggtgttagatggtcacagagcagctttttggaagcttatgtccatgtctcctgctaacagtagatacttgattagaatggaacagaatgtttacctgatttttacttatagcacctggaatgctagtagtaaaatgtaagccctttggagacagaaaatttttcaattctgtgttttcagagcctaggataattcctctgacctcactggtgagaatacgtaggtgttaaactaatgcacggattaaactataagggcaaagaaaaaagttcccctttgtcctctgaaggttcactgaaaaatcaactggcaaaaggaagattaatagaagaaaaggtatgtaaaattttattttaaattgcatagggagggaaccacaaaagaatgatgacccagtgaggtacacacgtttatatatctgttttcatagaggaagaaggcgatgtgtaacatagactattattttaagaggcaatagaccatcaaggagaatgaacagacccaggaggcaggaagcagacattaggagaaggtgaggtgcagagctacgcaggaagagaggttgttgtttaatgcaaattaagtcctccagataatctcttggagctgacctcaaaagaacagacggtaggtgtgtctgggctggtgaggactcccagcctcttgatctttcctggttacttgatgagatccctggggaggatgttcaagaccattgcatttctttattttattttattttcagatggagtctcactctgttgcccaggctggagtgcagtggcatgatattggctcactgcaacctccacctaccagattcaagtgattctcttgcctcagcctcctgagcagctgggattacaggcgcctgccaccacacccagctaatttttgtatttttagtagagacggggtttcaccatgttggtcaggcttgtctcaaactcctgacctcgtgatccacctgccttggcctcccaaagtgctgggattacaggcgtgagccactgtgcccagcctgtaaatgcccatcccattatatttcttttgtaaagaagcttgcttggtcagataaggaaatttcagagaggctcttcctggacttgggagtgggagacaagattagagagaccttcattctgaggcaaattctaagacggctcagcatgacaaagcaccagtctttggtatatctgagccccaacaaaataaactgatttgtgtatgaagaatggagcttacagctcagacagcaaatcaatccttattgactcagttttcaacttcatctggattaccagatgcacagtgtgaaaataagtcatttgccagcctgagcaacatagcaagagcccgtctctataaaaagtgtaaaaatctagctgggcatggtagtgaccgtctgttgtcctagctactctgcagcctgagatgggagcatcacttgttacagtgagctgtgatcatgatcaggtcactgcactccaatctagctactgagtgagaccttgtctctctctctccctctctctctctctctctctctctatatatatatatatatatatatatatagccaggcgtggtggcagtcacctgtaatcccagctactcaggaggctgaggcaggagaatcgcttgaatctggtaggtggaggttaaagtgagctgagagtgccactgcactccagcctgggcaacagagcgagactccatctgaaaaaaaaaaaagaaatgcatataatatatatagtatatatagtatatatatctatatataaaatagatatatatagtatatatatctatatataaaatagatatatatagtatatatatctatatataaaaatatagatatatagtatatatatctatatataaaatatatagatatatatactatatatctatatataaaatatatagatatatatactatatataaaatatatagtatatatatgaaaataagttatttgtattcaaagcatcaaataaaattttgttttagttttctaaaaaaatacaagtaacatatataggcatgctgtttttcttcttatatgtgactacattactttagtatgtagcaaatatcatttgctagctgtagtaaatgtgcattgtcacattttgtccaattttgttcaaactttaatcaaatgcctaagaatttaaaattaccttaattttgtagaagcaaatcacagcttatcattttagatgttttacttacttatgagtctactatttcccacgttactgctgtttctggcctgcctgtggcagtattgccattcactggaacctgcttccataggaggagcatcctgatgtgtttaggaatactaaaattcagatcattccccatcagagttgtctattctgtttctccctctcatccccataatgaatgcatacattctttctgtttgtttggtaattattgggtcatttaaaatgaagactatgaaatgagaacagaaccactgaccaaaatgtacaactttttaaacgtaccatggggaagaaaggtccagaacctatgcgcggagtatgttactaatccagagagaaagtatatttaaaaacaacctgagtggtcaggaagtcaatttcttttttctttatttttttaagagagacagggtctcgctttgttgcccaggctggtctcgaactcctaggctcaagccatcttccctcttcggcctcccaaagggatcagtttctgaagtgagatgagtgagttgattccttgagcattgtcttaatatgctacggctaccataacaaagtaccagagactgggtggcttacgcaacagaagttaacgttctggaggctataacgttctagaggccggcaaggttgtattctttgtgacctctctacgtggctggcagatggccaccttctctctgtgctctcacctcttccttcccctgtgcttgcacatccctggttctctcatccaagcattctattcttatagggacaccaggcagataggatttggcccaccttaatgacctcatttaccttaatcatctaatagaaggccctatgtccaaacagtcacattctgagacactgggggtgagggctctgcaggggagaaaaataatacctttccttcacctgctgcaaggttcgtggctgagtcctcataacaaaatccagattaacaaaagaaaagtatgcaaatgcattttttttttgagacggagcctcacttctgttgcccaggctggagtgcagtggtgtgatctctgctaaccacaaactctgcgtcccgttttcaagcgattctcctgcctcagtctcccgagtagctgggactataggcgcccaccaccacacccagctaatttgtgtattttttagtaaagatggggtttcaccatgttggccaggctggtctcaaactcctgatctcaggtgatccgccctgctcggcctcccagagtgctgggattataggcgtgatccaccacgcccagccacaaatgcatttaatgtaagttttatgtgacacaggagactacggaaatgaaaactcaaacatctagggagaactgtgcatttttatggacagtcatttagaagtatgattggaggacaaaagggtatgatctaatggtaataaactgggaggaacttaccaaggcctgactgttcaggttcttcttggcctccaagtttgatattccttcccttcgggcatagggcagaatacctgtcacatgagggtcttcaggagagaagaggtgggagcaggtcatttcaaacctttctccctctggagttttctgtctcctccagcttaaaatccttagtgtgccagggtgccatacattggggtagtatttcctgtactccagtagcttcaatgtataaatcttagccacaacaagcatgaatagagatttcaagctacagaaggaagcaaaggactaccgagaggtaaagatgtccaaaggtaactctggcgaaaagaatgaactccttgtacagctgtgaatgggagtttgggcaagcgttaagtctgaacctacctataggtgggactcttaaccattttatatttatgcagagcgagtaaatggaaaaatcccgtggaaaaacactaatcatatattgcgacttgagggggctacagatttttttttttttttgaggtggagtctcactgtgtagcccaggctggagtgcagtggctgcgatcttggctcactgcaagctccgcctcctgggttcacgccattctcctgcctcagcctcccgagtagctgggactacaggcgcccaccaccatgcctggctaatttttttgtatttttggtagagacggggtttcaccgtgttagctaggatggtctcgatctcctgacttcgtgatccacccgcctcggccacccaaagtgctgggattacaggcgtgagccaccatgcccggcttggggggctactgatttaaagaaagaaagattaaaaggattttgatgcaataactctttaaattttttttttttgagttggagtctcactctgtcgcccaggccagaatgcagtggtacaatcttggctcactgcaacctccgcctcctggttcaagggattttccagcctcagccttccaagtagctgggattatagcatgcaccacaatgcccagctaatttttgtatttttagtagagacagggtttcaccatgtttgccaggctggtcttgaactcctgacctcagaagatccgcctgcctcggcctcccaaagtgctgagattacaggcatgagccactgtgcccggccaactctttatttatttatttttttttttttgagacggagtctcgctctgtcgcctaggctggagtacagtggtccaatctcggctcgctgcaagctccacctccctggttcaagtgattctccagcctcagcctcccaagtagctgggactacaggcacctgccaccacgcccaggtaaaatttttgtatttttagtagagacggggtttcaccgcgttagccaggatggtctcaatctcctgacctcgtgatccacccgcctcggcctcccaaagtgctgggattacaggcgtgagccaccatgcccggcgccaactctttaatttttaaaattgggtttctggaggtgatatccatccttttccagtacacagtttatagagtttcaacaaatacatactgtcatgaaattaccaccgtaatcaatgtttcccatagtggccacagcttgggaaatcctaacaaaggctttaggcttcctggcctctgctgccatgaccctgtagaaagaatggattacgagattcgttcccacctgcccctccctgggtctcagatcttccctatctatcagataaggattggattgagctggtgtagccagtttgtctgtccctgtgctgaggttactacttctgctggcacccaaagcacttgttatagatctaaacaagttgatttcagtcatccagtccagcaagggaggacatgtcctatataaacttgatgtgcctgataacataagccaccccactggaagtatcagatgtttcccgcactactagagggttcctagcaccctggtcctccctgatcctgtcccccaacactgtgagatcccatagaaagtgggggtcaccttggggaacactgccataaaattagagttagggggccctttctggggttttatggtggcctgaaccacaaaccacccccaagaacatgcactttgaagagaaaaggaaaaagaatggtagggaacactgaggttggaatttcacaggaacagcctaattagccagctacctggtccacctccatccacatcaagctcagtgtttcccaacatgtgctgcagtgccccatttcccatgcattggagtgtagtgtttagtgttcatactactagatagaagtaccgcctcctgagcaggccttcttgatgtcctatcttcagttgctttggctgttccattgttcagtagctccattggcttgcagatgacagggtgcatacaaagcccatcatattccatgagagcatggccattgttttgctggtcatgtagtgaaggatgcttcttggtgagactgaggtcctctggggtgttcaaaatcatgacataagttctcctcaataacagcaatggtagtatcagcatccacaagcgtgcatattttttgtcctttccaagtagcaagctgttttgatagtctttgtccccacaaagaggctctttaaatattctagtcactcaattgccattccctgatgaggtatgtaggctgtcagcaacggcccacacattggtgaaatgcaggaagacctggtggtaggggtggcctgcatggtcatcacaaatgcgtgttgtttggtccactgggcaaattgccaaggtttattctgacaaatgatgatgacaaccacagcctaacagaccccatctgctctgttgtttcactgagccatcagtaaaccatgccacaccatcagcaggcttgtcttggagccttaggctccagacagccatgggaggagccaaagcacacccagtggttctcttggtgtcttctaattagctagccatttgttcacggagcctgctggtcacatgtggtcctagctgggcctgaacttgaatgcaccacttccatttgataagtgaagtctatggagcctgtctaattttattggttgagcttgtgagccatccagagagaaatggcagttcaggttgcagagtttcatctggcattctggccacgaggtgcccagtccaaaacagtacccaatatcaagtaaggattgccatttaaaagagggatataggccgggcgtggtggctcatgcctgtaatcccagcagtttgggaggccaaggcgggtggatcacctgaggtcaggagttcgagaccagcctgaccaatgtgatgaaaccccatctctactaaaaatagaaaaattagccggacatggtggcatgcgcctgtaatcccagctattcaggaggctgagacaggagaattgcttgaacccgggaggcagaggtttcaatgagccgagattgcaccattgcactctaacctgggcaacaaaagtgaaactccatctcaaaaaaataaaataaaataaagagggatatttggtggctgcctgaggcaacttatgtgtccaagatctgagaggctggtacaccccagtgtcagttttctgttgccagagacatccatcactgtgcatcaggttgcacacaactgtgatttcatctggctagcacatttaaggtttaaaaggaagtgcctgagacacaaattgttgtaaacctgctgctgcaaagggttccattcaaagtgtgtggctttattggttaccttgactctgggtgccagaagaacccccatgtgagatgcatgttgtctccagtacccaaagcgacctaaccagctgccaggcctcctttgtatccgtgagtgcagccaggggcttgcctgtatctgggatactgttttggcttcttgctcaggtagctttggcattcattgtgcccatggcctttttgaccagctaaactgggctgttacattgtgacaggtgggttgtcacttttttctttttttcgagacggagtcttgctctgtcacccaggctgacctggtgcgatcttggctctctctaacctccgcctcccaggtttaagcacttctcctgcctcagcctcctgagtagctgggattataggcgcccaccaccatgccctgctaatttttatattttagtagagacggggtttcaccatgttggccaggctgggcttaaactcctgacctcgtgattcacccacttcagcctcccaaagtgctgggattacaggcatgagcccccacggccagccggttgtcacatttttatctgtaacaagtaaatccagaattaataaaatagtgtcattgttccatttagtatgcagtaccactttttttaatgattcagtgcggcttgggtagcttaggtaacaggcaggagtggatacggcccactattgtgtcttagttcttagctgtgagggggcataatcttccaggacatcaatgcctataatgcactcagggtgggaaccagagccacctgcataaaaagttgctcacagggctctacccacaagtacataagcattgtgtgcagataagcatcacgggccaccagtttgttcccaaacctcccaatgtcatccgtttaattattctcctaaaaggacccagaaacattgtcatgtgggttccggtatccaagcacctgagaaaaaactgaagtcttctcttttctcctcttatcataacaagggtataaggccagagggcttcagtagggacctagaggccttggccccattcttaactgtgtcaatcagaccaagacacttaggtggcagtgttcctttatcaaacactcacaatagccacactgcgtaagatttccctggtcttcctccttatcctttcgagcctgactcttcccatcttctgggctgacattgtacgtgttagttcctctcatgcctcagggaccatacaaggacctctctctagtttcttcttgggtgcctcaggggctgtctgaatactcaccattcaagctcttgggccctgacaataagggatcacataagtgcccagcacctaggggaccttgaactatgatctgctgtttccacattcctttctctctgtctcagtccatgcagccagctcacttacatctgtggggaggagagtgacatgtcccatttaccacccatccttatccataactcatccaggtacatgtccagcccctgtgctcctgggctgatgtctctgccttgggctgagtactgggtggtattgcccctcccactttgccagaaagccatgtttctctgaccgaaccttacccactgcaccaatttttcaaagcaggttcaccaattaccaatcccaagggaggactccaccacacagaggacagcaaaggtcatcactataccagccatcaggaataggagtccagacacttctacccactgcatcctccgctgcagtgctacaactgcctgagagcagtgagacagaacacattctcaggcagtaagttaaaggatgcacatttattatttacagatagggagaaagtcttccttcaaaagaagcctaggctccattctgagctcatccccaaaggctcaagaagggttcccagggcagatgaagtctggattgcaaatgcccccctttcacacagctgaggaagcccaaaaggcagcccaccctgggttacatatctcagggcagacatggcgcattgagcaaagctttaaggaaatactgctttcagggcagagaggaacaaaccccagctctcctggacagtccctccctaactaaagatgtgacattccttaggaagggccagaacaaggccagggttgttccagacagtccctccctagctcagaatattgcattccaggctgatgctacacttattcttgacaaattaaaactgagaaaatgggaataattgaatccatccaaggccacctggaggactgttttgcattttcaccccaaaagttccttgtagtagtcttcccaccatatttagttttggaaattattgatatctatctccataactttgccttttacagaatgtcatataaatgaaatcattctgtatgtaatctttcagtaacactttcgagatatgtcatgtttactgtatcaatggtttgtttctttttgaaactgacctgtgctatattcaatgaatgtaccacaatttactcaattgtttatgtttttttttaagacagagtttcgctcctgttgcccaggttggagtgcaatcctgcaacctcggctcactgcaacctccacctcctgggctcaatgattctcctgcctcagcctctggagtactcatcatttttattaatataaaatgttataaatatggataacttgatggatatttgtgttgaggtattatatggttactacaagcatatggtttcattcatcttgggaaaatagatcttagcgctgagatgctggatcatataacaaaagtatgattcagaaggctggttgtggtggctcatgcctataatcccaacactttgggaggccaagatgggaggatcacttgaggccaacagttcaagagcagcttcgccaacatagtgaaaccccatctctactaaaaatacaaaacttggccgggtgcagtggctcatgcctgtaatcccagcactttgggaggctgaggcaggcggatcacctgagatcaggagttcaagaccagcctggccaacatggtgaaaccccgtctctactaaaaatacaaaagaaaattctccaggtgtggtggtgcatgcctataatcccagctactcaggaagctgagacaggagagtcacttgaacccacgaggcagaggttgcagtgagccgagatcataccactgcactccagcctggatgacagagtgagactccatcacaaacacacacacacacacacacacacacacagaaaacttagctaggcgtggtggcacacgcctgtaatcccagctcctcatgtggctagggcatgagaatagcttgaacctgggaggcagaggttgcagtgagctgagatggtgccactgcactccagcctgggcgatagagctgactctgtcttgaaaaaaaaaaaaaacgtatgattcactttacaagaaactgccaaaatgttttccaaagtggctatcattttgcatcctaacagaaaatatgggaatccccgttactccacatccttaccagcacttggtttggactctgtgtgtttgtgtgtgtctgtagtgtgtgtgtgtgtgtgtgtttgtgtgtgcgcatgagtaaatatatgtgtatatatgtatatatatcgactcttaataattccagtagggacatagtggcaccttactgtggtttcaataatttacatcttcctgctgataatggcattgaataaaactcattaacttgttcgtcatccatatctactatttgactgtcactcttctcatttcaaaaaatgtttattgttgtattattaaatttaactatgtatatgtataattttgatatgacctacatctgttaagtaccgaaaatatttttttctgagcctgtgccatctcgtctttctcttaacagtgtctgtcaaagagcagcatttattttaattttgactaagaataatttgtccttttttgttgtttttttttgagacagagtctgtctctgtcacccaggctggagtgcaatggcacagtcttggctcactgcaacttccgcctcctgggttgaagcgactctcctgcctcagcctcttgagtagctgggattacaggcaccctctatcatgcccggctaatttttgtacttttgtagagatggggtttcaccatgttggccaggctggtcttgaactcctgacctcaggtgatccacctgcctcagcttctcaaagtgctgggattacaggcatgagccactgtgcccagccaatttatccatttttaaattttgtgcttaatatttattccctaccattatatattgcttaacacaaggtcataaagattacctacagtattttccttagaaattttatgtgttaaggatttacatttatatctgtggtattttgaattaattttatatctagtgcaaaaaagggtgaagagttttgttttgtattttggcatatgaatgctctgttgttttaggagcttttgctacaaatactctcctttcttcaattcaagaaaattgaatttccgtggcacatgagtcaaaaacctaccaaccatatatgtatatgctataatgctccagttatctaaatatttatccttatacatatccatatatgaatatgcatatgctatacatacatacatatatgtatttgctatactgttccatttatctatttatccttacaccaataccacactatcttgactaataccacattatattaaacttgaaataatggccaggtgcggtggctcacgcctgtaatctggcactttgggaggccaaggcaggcagatcacctgaggtcgggagttcgagaccagcctgaccaacatggggaaaccccatctctactaaaaatacaaaaattagccgagtgtggtggcacatgcctgtaatcccagctactcgggagtctgaggcaggagaatcccttgaacctggcagacggaagttgcagtgagccgagatcatgcagttgcactccagcctgggcgacaagagcaaaactccgtctcaaaaaaaaagaaaagaaaagaaaacgtgaaataagtagtgagtcccccaatattgtcccttttcttctaaattggtttggctatactaattatttagtttcttacataaattttggaatctacttctcagtttctaaaaaaaatataaaaaatcagctgaggattctactgaatgtatagataaatatgtaagaattgacccttggtcaggcgtggtggctcaagactgtaatcccagcactttgggaggctgaggtgggtggatcacgacgtcaggagcttgagaccagcctgaccaaggcatggtgaaaccctgtctctactaaaaatacaaaaattagccgagcgtggtggcaagcgcctgtaatcccagctactcaggaggctaaggcaggagaatctcttgaacttgggaagtggaggttgcagtaagccaagatcgtgccactgcactccagctggggtgacagaacgagactccgtctcaaaaaaaaaaaaaattgatccttaatattgagctttccaatccattaaattggtatatctttatatttatttagatttttttgaatatcaatctgatcagcattttctaattcccagagcacacattttgcacacattttgtcaggtttatctcgaagtatatcacgtttttatgctattataaaatacattttaacttctatagtcaatttttcattatcagtataaaggaagtcaaccgattttcactcactcatttttacaaactaagcaaatctagtggcagccatgtggtatatacattgctacttgtgagggatggataaatgaaaaacatttctcctttatttgaggcatttgtcaagcagagatatgaacaaataggcaatgcaaatcagaggggttgtagtagggaatgtgcattattctgtggaaatccacaaaatgcatgggcatacaaaccaaatttaaatagtcatagaaggaatcctgcaggaagtaatttatgattgaataaagtagctgaaaaccatgcaaattagaattagacaagacaaaagaaggattagtattcaggtagagaccagggtgtgtctacaagtcaacatttttgagacatcacagggagagtaacaatttcagtacactgaaggaagttagaaatctatgtcagggctagatttttaagaaattttgttctgtgtcaataagttaggatttttatagttttctaaggttctattcagctactatggggtcgactcaagaatacagctgttgtaattgttaaaatgggaatttgggagtcttttgaatttgaaagaaaaaacaaatgtgcgggattgaggctcagaccctgtacaggcaaagaaaaagttaaaagtgaggaaaatgagagacaacataaactctgggaaaagtgttcacaaaaaattttagtattttcagggtagaagctcctcttgattgagtcataccttcctgcgaaagatacaaagtcagaaaagaaatcctctacctagaaaacgacattttggcaccaagcataggttactttcatgccttaatttcaccttaccagcatttcaaaatacctgctacactgtggtttgaggaatgagactactatgctcacagcgccacctagcatcaacagaaagggaggcccatggcaaacttaataacaagaggcgggaaaaaaaaggtgaggcccaggaaccggaaacttaatttgagcaggatttttcttatatttatttaaaaactaaaatattggccgggcactgtggctcatgcctgtaatcccaacacactgggaggccgaggcgggcagatcacttgaggccaggagttcaagaccagcctgggtaacacggtgaaaccctgtctctactaaaaatacaaaaattagtgggcatggtggcgggtgcctgtaatcccaactactgggaggctgaggcaggagaattgcttgaacctaggaggtggaggttgtagtgagccgagatcgcgccactgcactccagcctgggtgatagagtgagactctccctcaaaataataaaataatattgctgcaggggtcagtggtgaaatgcaatccataaccattcccagtaaacactcagcgagtcctggcccatgcccacttttcctgtcatttaacgcaagggttaaatatcaaagtgaatcccattatgctaattgatttacaaatacggatgtataggagtgtgataccctgagcgcaatcatacttcggatataactgtaaaacgacttcagctgactttgcagtgttgcagtgtcacattaaaccctaagttgtttgtgtttccctacacatcactctccaggagcattatagttcagaagattagagtaatttcttagactaaagccttgatgggttattattacataaaacgttttccactctgatggagaagtcaggtgcattcgctcatgtctccgtggcagggccgggactcctggtcccccgcgattctgagcggtgcctcacagcctaggtcctccaacctcacagggcggcccgcagcaaatgcgccactgtccggtgcggccaaccagctcgtggtgcgctgtgggaaggtcacaggacggagctggggggcgggggcggcggtgggggcgggggcggcggcgggggcgggggcgggggcgggggcagatcctatttgcgcctgcgcgggactggaggattcggtgttgccctttccccctgctatttccgtttccgcgcttcaagcggatctcttccggttatggcgcccgctgggagtgtcttatcagccgcttataccgcggaaactttaacctgcgttttcccgtaaaattttcctctctaggtttcgtatcattgtcttgtttcttactcttgtattaactttgttttaacctaaggtttctctttcccaaaaactgtggtgtttctttacaacctctttttatagttatataaacattgcaagaaccatgattttatattcttccttttcagtattaataacttcaatgtcttttttggcatttgtctgaaaatttgaaatatttttcaatttactgaactgattatcgttttgtaaatatcggatactactttaatcatttgtgtattggccttaagattctctatttttaactcttccaccaacatacctttaatctgagaggtgttgtaggggcttcaagatcaaactttccccacagtctctattttcattataaaataccgtgttttaagaaaaaatgtacaaggttgaaagaagtttcactactacgtgttttttttttaatttttattttattttattttattttgagacggagtctcgctctgtcaccaggctggagtgcagtggtgcggtctcggctcactgcaacccccgactccctggttcaggcagttctgccgccgactccctggttcaagcaattctgcctcaacctcccgggtagctgggattaccggcacatgccaccacgcccagctaatttttgtatttttagtagagatggggtttcaccatgttggccaggatggtcttgatttcctgacttcgtgatccacccgcctcagcctcccaaagtgctgggattacaggcgtgagccaccgcgctcggcctctactatgttttaaaacagtggctaggtcatgcttttctgtgtatccttacttcccttattccatcacctcatccatcactttacaactgatcatacaattacaaaattattttactaatcagattaaatgtgtgccttccatttgaagaagaaaggtctactaaaggcttagttttccctaggacactgggagaatacaggatctggtttccagtgccacagtggtgatcacacaggaataaacgggacacaggtcagacaacagccagaaagtcatctgccagtatatgtttcctgtgagatggacacctggtcccaggtcagacacaggtgttagagtgtcagctaggtaaaagaagtaacctgaaagagacacgctgtgaacaactatgtccacctccccttcatttcctagtattggagggctgctagctgctctgttactaggacccagatttagttggggcctctcagaacaggtcagaattgacctatgcacagtacctgtgggagtctggatgagggccatccactgaaagttagtgaatcaaagatttaagattgatctaaatgcaaatagatctgtgtcaaacgactatacgcataattgccttattttatacttattgaaaaaatcctcgtaaaattataaaggcataagatttacttgttatgaaaatgaaggcaataatgaacgtaattcataagtgaatttgcaaatatcttgaaattccaattctgatttttccaaattagattttgattcagagtcatcgatgtcttcacaccaccctctgtggcatgaacagagatggtaatgaagcatttcttagaaaacaaggctggaccactgtctgtgtgatttccacctttcttgctgacaccattctgcatgttttgatgtaagtgatgttaccagaaggaaacagcagaaggttgcaaaacaagtgcaaacaatgaaagccatgtcatggctgccaacaggctaatagtgattgtaacaacacttgacaaaataatttttaaaaattattcaaatatgataactaataacgatacagaattatcaagggaggtccaatttttttttttgtctgagacggagtctctctttgttgtccaggctggagtgcagtggcacgatctcggctctctgcaacctccctgacccaggttcaagcatttctcctgcctcagcctcctgagtagctgggattacaggcggctgccaccacacccagctaatttttgcatttttagtagagacggggtttcaccatgttttttggccaggctggtctcaaactcttgacctcaggtgatccacccgccttggcctcccaatgtactggaattacaggcgtgagccactgcacccggcctaagggagctctattaatggagctgaatctatgaaacaagaacatcttccttcatcaagggagcaaaactgtccagaaaaaaagtacagatgaggtagaaggagcctggtctatgtgttcatctttgtggtggattgagaatagggaggctggagaagaggctgagggggaagtcagggctcactcctgtcctaaaagcaaaagggagcaaaagaaccatgttcatcttcagattcacacattcttcactttgaaagaaaatttaagtttattaggaaaccatatctgtgaggagtttttattttttttttgttttctttttttgaaacagggtcttattttgttgcccaggctggagtgcagtggcatatacactgttcactgcagcctctacctcctgggccctagcagttatcctacctcagcctcccatgtagctgggaccacaggcatatgccaccaagccctgcctattttatttttttgtaaagacgtgtctcactttgttgcccaggctggtggggggaagttttagagattcattaaataatttgtgaaatttaaaataaaggaaaatattctgttttgggttttgcccagtgcatgtttggggctcataggtgaacaacatggacaaaataacctctgatatttcagtccagtagtgattcaaggactgtaacccaaatctcaaatgtaggagttttgggttacaaaacttttgggagctgagagcacaggcatcagacctgaaatggaatggacaaggaaggcctctaggaggaggaacattggaggaggttctggagagcgtggagcagtgaatctggcaaacaggagaaagagaagaggaaaaaatgtgtctgtggcacaggccagggcatgagaaggggacagtggattagaaggactgctgggattagcaacatgtaaggagggcaggagcgggaagggcagaccatggagaggctgtgaaggggagagtgggcaggtcaggaagtgacacagggccggccagcccactaaggaatgcatttgttgtgctggtagttcaaatatcagtctcgttccttgcaacagtacctccaggtcaagaagagtgaggatagcctctgtgtctgaggaggtccctgtgcattatgaggaattggttctaggaagaagggagagtgaagaggaacagagaggaccctccagatccagtacgggccaactaagggaacttggatgctcctgttcatgtccctttctccatcactgagactcgccccatcccaccctgaatgcaggttcctttcccctcggttattttgtgcgtctcagatgatgacatgtattgtaactttattctatcacatatgacttttacattatatcatagaaaaagttacttacataaattacttaatggtggattagtcatagttaaaatgttgtcagcttggtaaacaaatgaaattatcacactttagtttttcttcgttgatcatttatgaagattagtgtctcctcatttcatggatgtcacaactacatgttcttaagtaaggtgtatgcttggggtgttgtgttttccctgttaatgttggatactccagtgttcagcaaactataaacctatcaacacacatttgaaaaatccagttgttttgtgttttatttcgtgtatcctgtctttacaatattatatcttttcttctgcttacttgaaatttaatttgctcttctttttctaggttcctaagatggaaacttaggcgatcattgggcatcatcatagggtctacctgccaaatcaggtcttcttcattctgcaaaagtttctcagtcaccacttatatttcatgactttgacccttgtgaaaataccagtcagatatcttgtggaatgtcccacaatgtgtatttgtctgatggtttctcataattagactagaaacaatgtgtaaattaaacatatttttccaaattagaaaacaagaaaaacagaataacatattagttagaagtattaacatagggctggacgcagtggcttatgcctataatcccaacactttgggaggtgaaggtgggcagattaattgaatccagcaattcagcaattcaagaccaatctgggcaacatggcagaacgctgtttctaaaaaaaatgcaaaaaattagctaggtgttgcagcatatgtctgcagtctcagctactcgggaggctgaggtgggaggattgggagggtggcctgagcttgggaggtcaaggttcactgagctgtgattgtgccatagcgctccaacctgggcaagagagtgagaccatatctcaacaaaaaagagagaaaagaaaaaataacagagaaaaataatttttaaaaatcaggtaatgacaaatagggaattccaaatatattgctaatggtctgttaagcttgacagtgcttttagaaaacttgttctgtttagaatagtgttagactcacagaacaaattggtaatataaagagtttacatataccacacacagttttccttattataaatcttaacattagtgtgttacgcttgttacaattaagaaccaatgttaaacattatcattcactgctatccatgctttattcacatgtccttaatttcacttaatgtccattttttgattctggaatcccatccaggatgacacatcatatttagatgtcattcctctttatgcttcataagctgttgacacttccttcaactttcctggtctttcatgacattgacatacttcattaggaagttgtctgattttttttttttttgagatgactctcgttctgttgcccaggctggagtgcagtgacgcgatctcggcttgctgcaagctccgcctcccaggttcacgccattctcctgcctcagtctcccaagtagctgggactacaggcgcccgccaccacgcccagctaatttttcgtatttttagtggagacggggtttcaccgtgttagccaggctggtctcaatctcctgacctcgtgatctgcccacctcggcctcccaaagtgctgggattacaggcgtgagccaccgtgcccagccataggttttcaaaaggaggactacacagggaaattgccattcttatcacatcataccaatgttacatactaatagcatgtcatatcatgttgaccttaatttgattacctatttgaattacttcttatcagattcttccactgttaaattgctatttgttacacttcctgtgttgtacttttgaaaagaagtcattaggcttagtaagaagtgggaagtcattcttcacctctttatgggaagagtatctgcaaaaataatttggaatccttcaacatgtgaaatgtgtcagttttcctccatttgttttatatattttttcactcatttatttatatcaatatgcaaacatggatctttattttacacttacattttactagtttattttgttgttcaaaattttctactcttggctattggaaggtcttttaattggctactatatcattttcgtatacacactcctagtataatggcatgaatccgtttatgaggctaaagccctcaaggcctaattaccttttaacagccccaccttttaatactgctacagtggcagttagtttccactaactgtaggggacaaaaattcaaaccatagcaagaacataccaaaaccatttttaaaaacaataatgcatttatttctgcaaaaaatggccataaagggccacctttatatgtgatcatgtagatcaccctctatatgataaggaagacaaatggagaacgaattagatagagaactgttgtgaattaaagtattaggtttggaatacaactttttgggttgattgctcatatttcttagaacagaaattctcagtgtacaactttaactctgaagaaagctacccatccaatgaagaagtagcaaagtgactgtttgccatttctatcttccttctcaatagatttattgaaacatagcatatacatcacctctccacatttgttgtacttttgttatttctagttcattcttgaggtttctctttaacacagcgactattaattctagcccagttggccaggagctgtggctcacacctgtaatcccagcacttgaggttgaggtgggtggaatgcttgagctcaggagttcaagacctttgggcaacatggtgaaaccccatctctactaaaaacacaaatttagctgggtgtggtgatgggcacctgcagtcccatcaccatactcgggaggctgaggcaggagaatcacttgaacttgggaagcagaggttgcagcgagccgagattgtgccactgcactccagcctgggtgacagagcgagactccgtctcaaaaaaaaaaaaaaaattctagtgctgctcaagaagcctctagaagatttgttcatggatgtttacattgtgcctttcagggtacacttttttaaatcttattttacagccaaatacataattatctgatttgtcagtggttttattctccattgtgaaatgtaaagtaatgatgcaacctataattgatgtgaataatttattttgcaattactatttatgtcagtatcagcaaatactacattcatttgtatagatgatattaatctacaggttttatggattattagttcatttcatcctcacagcatctcaagaggtcggcactagttttactcccaatcacctagtgaatttgatctaaagccctacaagaaaggaatggatgaaacttgattttgactgagtctatctttgaagtctttacttacatcacgtgttttagaatatctttttttgtatggaaaacacattctaggaccggattaagaaatgttactctagggccaggcgcagtggctcatgcctgtaataccagcattttgggaggttgaggcaggcagatcacgtgaggtcagaagtttgagaccagcctggccaatgtggcaaaataccgtctctactaaaaatacaaaaaaattatccaggcatgctggcgggcacctgtaatcccagctactcaggaagctgaggcaggagaattgcttgaactcaggaggaggaggttgcagtgagccaagattgcaccattgcactccagcctgggcaacagagcgagaatctgtctcaaaaaaaaaaaaaaaaaaaaaaaggtattctaccccggaagtcatgttcccaaattagatgtaaatcctgtgttaaattgatttaatatttaggtctaagatccacctaggaatgattttatgtgtaatgtgaggttatagatcagattttatttttccctgtggatatatttcttgaaatatttatagaaaaattcacatttccccaattaatcttataaattatttgtgtatatatgcttgtgtctgatttgctctctcctttttttttccattggtttatttctctgtgaaaatatcacactattttagtaagacacttcatttaacacagaattttctctctagggccttctcttagccaagtgtgctattatataaagaagaaagagtgaaaacctctatgccttgaacctacaccaatattctcagttgtcccttgaataaagagcagaatttagaactcactattactgatgacacttaggtctttaatgttcttgtgaatcttagacaacccccacaacatcattccctgctttatttgcttagtccattcttggtggattttatgagatgtcaacactcctcattaggattccctccttctgaagcctttgggattttctacccacccagcaaccaccagaggtggcagaaacccctgcagacatccttcttgcgcaagcgcagttgtaccatgaatgcggtcgtcctgctgcagaccacgcccaccaagggcggggccacatccactgcagctgagctcagagccttctgtggggtctgcagtggcaaggccagccgccccctgtcttccctctggagctgtttgaggaatgcagttcttttgcataagaaaggcttttctctccagtcattctgcttgctgatcaagaacacttaacagcttcaggctttcctggtaatattcattcttgcttttgtgtttttgttttaaggtccaaatatctttaatacttgtatgcagttttcttttttataatttcacataaacatcatctaaaaccaacttcgcatgttcgcattctgtattaacaactttcgtttttgtatttaaaaatacattcataatcactttttcaaaatatcttgtcagttattttcatcttttccatgatcattctttaccagtgcaatggaaatattacttttattaggaaaagcagatgtcacgcggtttttagtgttgtcgagaaatttcctatgaaacatctctggttgaaaaggagaggaacaaaattttatgtgaggcacaagatcacatatgctcagaatcgcatgctttaataaaggctgtgattatttgcattatattgtttagcttgttctaattgtaaaaggtagacaaagaattaatttgtgtagacagaacattgcgactcccattctaaatgtagagacagtcactgcactgcgcaaataggaatgtcgtcatgttgtttgcttttctccttaccccaaaactgtagacattggctagagtctttgatttttttcccaacttgcttttgtaattgtcggcatgatgtttgcacagataaccaatgatatagatatatatttttttcttactatttgatgaatgattaatattttgggttttttttatgttttcagtgaatcaaaaatatcattcagaaaatgttgtcatccatatccaggtagcatatagttttataatctgatcttgtaataaggaaattacagtccttattgattttctgttattagttagcattttttaagttttcatgcttgtgagtatttgggaattttttttttactctgtcaataatttaacacctttgtattggtcatctgggtcgatgtctattgtttaggctcaacctttgacactcctctgaggtagtttttatgtgaatttgtaaccacccaagggattcaccttgccagctgtctagacagagccgatttatcaagacaagggaactataatagagaagcaagaattcacccagagccggctgtgcaggagaccatagttttattattactcaaatcaatctccctgtagggggatcaggggtttctaagaataatttggtgggtagggggtcggaaagtggggagtgctgattggtcatgttggagatgaaatcatagggagtggaagctgtcctcttgcgctgagtcagttccccggttggggccataagatcagatgagtcagtttattgatctgggtggtatcagctgatccatcgggagcagggcctgcaatagatctcaagcactgactgagcttaggtttcacaatagtgatgttatccccaggagcagtttgaggcagtttagagtcctgcagtctccagctggatgaatcctaaaccgtaatttttaatcttgtagctgatttgttattcctacaaaggcatgatggaggggggttgttttgggaaagggctgttactgtcttcatttaaaagctaaactataaaccgaattcctcctgaagttcgcggggaatgaacaagggcagcttggaggttagaagcaagatggagtcagttaggtcagatctctttcactgtaataattttctcagttatgattttttgcaaagatggtttcaaattgatggcttagtgtcctgggtagtgaaaatggaattcctcaacctgaattgaacatggatttcctcctgaagaaacaatttagggctccaaaaagtaaaccaggagcctggcacagtggtcacacctgtaatcccagcactttgggaggctaaggcgggtggatcataaggccaggagtttgatactagcctggacaacatggtgaaaccctgtctacttaaaaaaaaaaaatacaaaaattagccgggcatgctgatatgcacctgtaatcccagctactcgggaggctgaggcaggagaattgcttgaacttgggaggctgaggttgcagtgagtcaacatcgagccactgcactccagtctgggtgacagagaaagactctgtggggtatgatgaggcttctcttcaaatagcctgatcaatcgtttattctttaattaatagtaacccccacccccttttcctttttctcttttttctttctgcctttgttgcatgcccggacatgccacagtagcaggcttatcagtaccagctcacattcctttccttatttggaaaggagactagctctctagctcattgcagacaccccttccccttttcccctctctcccttatgtgcccaccttatctaaagaaagttcaattgtctagccaaccaggattagttcagactgtgcgacctgacctccaccaatgggaaaagggtacaggggcaggacttggggcaggaataaagactcttgtgcccctttgttctggtgtgctttcatggcgactggccaaggagaagcacccctctgcgcagaagtaaaattgctttgctaagaatcctttgtttgagtgttcaatctcccttaggattttgagcattattcccaaccattcaatccaaaaaaaaaagtagaccaggattgatttagggcctgtattataaattgtacaaatgccaacaagattgtattccactagaggaacgcattctctagtgaaggaagcattcctgcaggatgagtccctgagactcactagcaaatttcatacaagtaatgaaatcctcagtctaatggaataaaaacaattccaggggcatttgttaaagatgtataagatgtgagaaaccaacagactaacagcattgatactttatggatatttttattccaaattaatagatgtgttacaggaaaagggtcctgatccagaccccaagagagggttgccgatattcagggccagtctgcagagtaaagtgaaagcaagcttactaagaaagtaaagcagaaaaagaatggttactccatagacagagcagccctgtgggctgctggattcccattttcatggttatttattgattatatgctaaaccaagggtggattatccatgcctcccctttttagaccatataaagtaactttctgatgttgccatggcatttgtaaactgtcgtggtgctggagggatgtagcactgaggacgaccagaggtcactctcgtcaccatcatggttttggtggattttagccggcctctttactgcagcctgttttatcagcaagatctttatgacctgtatcttgtgccagtctcctgatgtgacttaaaatgccttaaccatctgggaatgcagcccagtaggtctcatcctcattttacccagccctattcaagatggagttgctctggttcacatgcctctgacagatggacatttgtttgccaagcaatgctgcaatcaggggctctggatttcagtcctccatacagagaatgtcaagggcagaccttaataaaaataaataaatgaataatcaaatttttaaaattacctctttcattcttttattgtattatgatctgacaccattaactttaattttcttgcatatggagagcaacttgatacaaactggtatttatttagtgaagaaaagagataaggtgattcccaaatttaaaggaaactggaagttttgtgggaaacaaatggaggagataagacttactagtttctacttattttaatgagaattgtgttgttcatttataaatacaaagctccatttaaattacagatgcttttgatttatgatgaggttacttccagataaacccatcacaagttaaaaatgtcatcagtcgaaaatgcattgaatatacctaacttagttaaaatcacagcctagcctatcatccttaagtgtgctcaaaacacttatattagcctaacgtttgggaagatcatccacacaaagcctattttatcataaagtgttgaatatctcatgcaatttattgaatactgtactgaaacagaaaaacagaaagattggacactcaaagtatagtttccattaatgtgtattgcttttatttaatttaaaaattttaagttgaatcatagcaagtgaggaagcccatatattataaaatgtaataagtttaccagccacaaataacaacaaatcataggaaatgcagggattgggttgaggtgaggtggttcaacctattatacccatttccttcatctctaatgggctgcccttcatccttggggttgttgcagggtggctgtgcagtgcaaagggcacacaagaattgcttgaacctgggaggtggaggttgcattgagctgagattgtgccactgcactctagcctgggcaacagagtgagaccccatctcaaaagcataaataaataaaaggataatatctctgtcaaagtacagtgatgcattgcttaatcatggaaataccttctgagaaatgcattgtttggtgatttcatctctgtgcaaacatggagagcattacacaaacctagaaggcatagcctactacacatccaggctacatggtacttactattgctcccaagctataagcctataagcatgtgactgtcctgaatactataagcaattgtaacacaatgataagtatttaaacatgtaacctatctaaacatagaaaacataaaaagatggtataaaacaaaaaatattgttcagttgtatagggcagttgccatgcctggagcttgcaggactggaagttcttctgggtgagtcagtgagtgagtggtgagtgaatgtgaagacctaggacattactgtatgctactgcagactttagaaacactgtaaactaaggctacacttaatttattaaaaactaaagtaattgtgctatggcatcgtgacagctttgacatctctaggtgataggaagttctcaggtcaattataaccttatgagagtaccctcctatatgttgtctttccttgacagaataaaatatcattttgagagccatgactaataaacacataagagtcgatttaatatttattttaaaagcccttccatagttataaaagcataagttttagtcacatcaaaatataaacaatcttgaaattaattcataagtaaatcaatagatatcttgaaattgtgcttatgatagttctaaaccagactttaatgcagaatcttggatatcttaatcgcactgtgtggcaggaagactgatggcaataaaacatttcttaaaaaagaggctgcagcattttctgtgcaatttgcaccattcctgttcacacctgttctgtaagtgttgctgcaggcgatcctgtaagaaatgacagcgggttgcagcgcaagttcatgcaaacaatgaaaagcatgtcatggctaccactaggctaacgctattgtaataaaatttgaaataaaatagactagaaatgatgaaatatgagaacaacattggaaatatttatcaagggaaccatattaatgtaagcgaattttagagaacaaaatacttttcctaggtctgcaaggacaaaactgtccagaagaacagaagagggacagatgaggtagaagcagcatggcccatgagaggggctctgcagtggattgagggtggggaggctggcaaaaaggctgggcagaatcagggctcacatcctgacctgagaacagaagagagcacaagaaacaggttcatcttcaggcacaaatcctcttcagattgaaagagagatggagtgtctagggaagtaggcaagcatttggggaaggagagtcactgattcattagtgaaacacaacaaaaaaacaaaatcttctgtgttgctgtttgtccactgcatgtgtggggctcacaggggaacaacatagacaaagtttccaaattctcaggtgtttaagacgagtgaggattcagaaaacttaacagaaactaaactgcaagtgcaagagctgcccttaggaactcaggggacaggcatcaggcctgggatgggatggacaaggggggccttcaggaggaggagcattggaggagatgctgaagagtgaggggcaggggatccaccagacaggggaggtaaagggaagaggaaacagtgtgtctggcacagttcagggcatgagataagggcagtgggttggaaggatcgctgggatgaataatatatgaggaggcaggagcaggaaggacagaccataaagggcctgagcaggggagggaggacagctctggaagtgatgcagaggctgctccctgcggactgccttctgtggggaggagttcgaatgccttttcttcttttaagtgttactcacaatccatgagatctactgacaaggaagacagttggaacaagtaagaatagtccttgtttgatgggaaggagcagtagcattaccaggaggggttggtgttggggaggggcaagggtggggaagggcagagaagtttctgtcccctcagccattttgcagatgtaggttggatcactggatcacaaattcacagtggctggctcatggccaccttgcatcacagggtgagagcagcctcacaggaaactgcagataaggggggttcccagctgcacagaagaaggacagcaggtaactttcagtcaaggttggcagggggctgcagaggtggcagcaatgatggtggtgggcagtgtgcagccttgtaggccactgtctccatggacatacagatttgcacgcatctgtgtctgcgtgtcctctcggtgtgctgacattcttacaaaatcctcatgaatttctcattgttctgagaccataacatgtattttgacttttttctaccacatgtaccctttcatgtgtacctagcaaaattgaccaaaattccttattggtggattattcatagctacagtattttccaacttaataactaaatgaattgccctgctttgtatatgtttgcctaatcattcctgaagattcatgtctcctcatttcagggggagccacccctgcatgttcataagcaggagttcagtttagggtgttctgttttcctagttaactgtggacacatctgcgttctggaaactattaaactctcaatactcatttgaaaattccagttactttatcttttacttagctttcactttatttacagtactctctcttttctcctgcttactttggatttcgtttgctctacttttaagtttcctatggaggaaatttagattatcgatttttagatgttttttcttttttaaattttatttatttatttatttttattttattattatttttttttttggagagggagtctctctctgtcgcccaggctggagtgccatggcgtgaactctgcttactgcaagctccgcctcccgggttcacactattctcctgcctcagcctcccaagtagctgggactacaggcgcccaccacaacgcccggctaattttttttgtatttttagtagagacggggtttcaccatgttagccaggatggtctcgatctcctgaccttgtgatccgcccgcctcggcctcccaaagtgctaggattacaggcaagaaccgccgctcccggcccctcttcttttctttttttttttttttttttttttggtggaattttgcttttgtcacacaggctagaatacaatggcgcaatctcggctcgctgcaacctctgcctcccgggttcaagcgattctcctgccttagcctccctagtagctgggattacaggcgcccgccaccacgcccagctaatttttgtatttttagtagaaacggggtttcgccatgttggtcaggctggtctccaactcctgacctcaggtaatctgcccacctcagcctcccaaagttctgggattacaggtgtgagccactgtgcctggccaatgtttttttttgtttgtttgctttgtttttaatagatacatttcccccctatgctccctcactgcattctacaaattttgataagatgcattttaatttaaacttagttcaaaatgttgtttaattttctcttgagatttcttgcatcatgtgttatttaaaagtgtgttagttaatctccatgtattttgaagtttaccagttatgtgccttttattgatttctatcttaattttattggggttttagggtatatatttgttaacataaaaatcatgagatctataaatttggaaagaaaaagagctataaatattcttgaaggtagccctacagcatgtatactgaacaaacatgcacgtaacctatgacccatgttcaccttggtgtggagactgagcttttttttttttttttttgagacagagtcttactctgtcccccaggctggagtgccatggtaccatcgtggctcactgcaacctctgcctcccaggttcaagcgattcacctgcctcagcctcccaaataactgggattacgggcacctgccaccatgtccagctaatttttgtatttttagtagagacagggtttcaccatgttggccaggctggtcttgaactcctgacctcaggtaatccacccgccttggcctcccaaagtgctatgattacaggtgtgagccaccacgcccagctgagacttaacatttaaatgtattacagttaggccctacacacaaaagcccctttcaggacacaaaggcagacaagtacacaatctctagaaaccagtcagacccagtccatgtttggtgggctcttatcaggagaaagttactgaaatcagtctcttgtgcaatcaaggctgtagcgatggctgttggaacagaggctggagttagcgtctggcggtggatgagctgcaaattgttttaagattgtttatgtggaagtcagtgcttgcttagctgctagagaaaaagataaacctcctgtcagttagaacatagtttattcttcaactataggggtgagtgacttaacccttgcctgtcatggccttaggtcttatttataatttgatatcttattgccaccaagaagagttcattccttcattcttatgatctctattttaatatgaatgctggtcagttgttgtgtctaaactgcaaaagagacagatgataacgaggcatgtcccacttcctgtcccatcatgactggaaactcagtttgtatggtttccctgcggtcctgtctgttcagtcagttggggggcttaggattttatttttaattctcatagaggagtgttgaagtcaccgaccgtaatagtggattcatctatttttcctgttttaacggtttctgcctcgtagttttatgttctgttgctacatgttagaattattatatcttcttggaaaattgaccccactattattatgtaatgcctttctatttccctgataatttttctgactgtatagtcagctttttctgaaattaatatagctactcctgctttttctatttgcttgctatattttgttccatctatttactttcagttaatatgtctccatttttattaaataacagataaaatgagatgtatgtactatgtataacatgaggtttgaataataatgtgcattgtggaatggctaaatccagctaattaacatgtgtattacctcacatagttatcatttttgtggagagaacactttctatccactttttaagcatttttttaaatagacacaggctctcgctctgcacctaggctggagtgcagtggtttgatcacagctcactgcagtgtagacctcctgagctcaagcaatcctcctgcctcagcttcctgagtagctgggactacaggtgcacaccaccatgcccagctaatctttagcgttttaaaaataagacttatgtttttaactagagaaaccatatggtacaatagatctcttgaaattattcctcctctctgactgaaattttgtatccatccacaaaacttctgcccaaccccaccctcaaccccaggctctggtaactaccgttctacatccccacttgtatgaaatcacattttttagatttcacatgagtaagatcttgaggtatttatctttgtatgcttaacatttcagttaacataatgtactccaggttcaaccatgttgtcgcaaatgacaggatttcctttttatatgcctcagtagtattccattggggattatatatataattttctttatctgtcaacggacacataggttgattccgtatgtttgctattgtgaacaatgttaaacacttctcattgaggagtgttgaagtcaccaactataatagtggattcatctatttttcctgttttaacaatttctgcctcatagtggtttgaacactgctaaaatatacatgagtgtaggtatctcttcaacatactgatttcattttctttggatatatagccagcgttgggattgctagatcttatggtagttctatttttaattttttgaggggcctctatacttttttcgataatggctgtaccgattaacattctcatcaacagtgtgcaggggtttcctttacaacacctgttatctttactctttttaataatagccttgtaacaggtataatatctcattttgattttaatttacatttccctgtatctgtctttatatttaaataagttttttttttttgggggggacggagtctcactctgtcgcccaggctggagtgcagtggtgtgatctcggctcactgcaagctccgcctccctggttcacgccattctcctgcctcagcctcccgagtagctgggactacaggcgcccgccaccacgctcagctaattttttgtatttttagtagagacagggtttcaccatgttagccaggatggtcccgatctcctgacctcatgatccacccgcctcggcctcccaaagtgctgggattacaggcgtgagccactgcgcccggccttaaataagttttctctagagaacatatggttaagtcttgttttttgatccactccaacagtctgtgtcttttcattggtggttttgagccattgaaagtcaatgtgattattgataatagcagattgctatctaccatgtttatttctgcttttcatttgctgcccttgttctttgttcctcctcctgtcttccatttgtttgcttccctttatggttttaattgagaatttcatatgatccaattttctcttcttagcatatcattatattttctttttatttttaaatattttagtagttgccatatgaaataaaaactttttcatattttagttgatataacagataacagtttgttaaaaacaaaaattgtagccatttatttgatgaggtattcttatgtttatagtttgagtgtgtgtgcatgtatatgggtgtgtgtgtgtatatatatatatatacacacacacatatacatatgcatgaatgctcatatataaatgcaatgaatgacagcaatagtacaaattaccaaagtacaaatgactattgtttccttattataggcaactcacactacttgtgaactgatagagtgttatttgaaagggagtttgaattaactgtaaatttagggactggctattggattaagatcctccattccttggctggctgttgtccagaggctgcattcagctccttcccatgttggcttctcccacatggcagaatgctccatcaaagctacaaggggagagtttgctagcaagacagaagtaatgattttacatagcataattacccatgtgatgtaccttcagctgtgctctattctcttgtttcaaaataagtcaaggttgctgcccacacttacagggagaggattagaatgcaaggttgtgttcaccagcaggtgggaatcactgggtgccaatctagggtctgcttgctgtgtcagatcttctccaacctgcaacagtttctcagtgttcaattattttgtataacctgaattcttttgaaaagtaccagtcaggtgttttgtggaatttcctacaaaatggattagtctcatgggtctcattattacaatagagatatgcattaatttagacacatgtatgtgggtgttaagaaaaactgaacaatgtattacttagaaatacaaaaggagagaccaggtgcaatagctcacaccggtaatcccagcactttgggaggacgaggtgggaggatcacttgaggccaggagttccagactagcctaggcaacatagccagaccctatctctaaccacaacaacaaaaatttaaaattagccaggcatggtggtgcacacctgtggtccaagctactagggaggctgaggcagcaggatgtcttgagcccgggaggtcgaggctaaagtgagccatgatcacaccacagcgctccagcctgagctacagagtgataccgtgtctcaaaaaaaatggggatatgcactcaggggttttcaacaatattgacaaggtttggcttattatactgggaagggaatttataaaaaagaaacttgttaaattttagaatagtttagatatacacagcagttgccaagataatacagatcatttccttatgcttagcatatagtttcccttattattaatcccttacattagtgggtgatatttgtcacaattcataattcagtagtatacattatccttctctatgattcacattttatttagaatttttcttctaccgaatgaacactttgtgttccaggattccctccaggagaccacatcacatttagaaatcccatctcattaggttccttctgcctgtgacagtttctcagactttccttgttattgatgacattaacatccccaatttgggatttctctgacatttttctcatgattatactggagttgggtttggggaaggaagatcactgagagaaaatgtcattgtaaccacatcatatcacgggtgtctactatcaacatgattcatgcctgttgatagcaatttgattacctggacaagttagcctttgtcaaatttctttactgtaaaattatttctttctccactttccctgtttcactttttgaaaataagtcagcatacatagcacatacttaagaacaagaaagttatgctctacctccttatgaactgaggacctaaaacaagagttgagaactctttactgtatacagttggcctgttctccaccatgatttcataccatttatttatactgtattgaatatgatatgaaattagatatattcagttcacatctcccttatactcctttatttcatagctcgaattgttccattgttggccattggaaggtctctcagttggctcccatatcattttgaaatagccacattattttggttagattttgcttgtttggtggttcaattgtaatgtttcatagtttcttactttcaggcactacagggtcctccaggccaattgtgtttatttcgtgcccaagcctggtacccatcatttcttcaagggtcctagtttcttttattggaaaatggcttttaaaacaaagatacagacccaggtatattcactgatactgggtcatctgtcgatttgaggagtagtcagctgacaaaacaatgaaacgtacctgtgtatactaacccacacatatacacatatgtgtaaatatttcctcatatgttcatatataacctgattaacttaaacataaattcctactaatgtctccagcactacatgaatataatataacttgaatcaatctccccattcccactacttggttgtaacccccactctaacagtgagtgagttggccttgttaacttaatcaccaagttagaggctacatgcatagtggcttcagaattgttcatccacactctcatgaagaacaacattaccaactaaagtacagtgctcatagacaacttcttggacctttagatgcagaatcttcactttgtacccaagttacttaggtcagttctttcccccgcctcccagcttcctttagtgaggttatatcatacatttcttattcatttttcttattttctctgtattcctctatgggatccctcaacctacaaataattattttctctgtattcctctatgggatccctcaacctacaaataattttttttttttggttttttgtttgtttgtttctttgttttttgagatagagtctcactctgtcacccagcctggagtgcaatggtgtgttcttggctcactgcagcctccgcctcccaggttccagcaattatcttgcttcagcttcccaggtagctgagattacaggcacgcaccaccacgcccggctaattatttggtatttttagcagagatggggtttcactatgttggccaagctggtctcaaatacctgacctcaggtaatccacccacctcggtctcccaagtctcccaagtgctaggattacaggcgtgagccaccatgcctggcttacaaataatatttttaatttccgtacatttaggttcactgtttgtattataaagttatgcagggtttcaaaaacaatatgatgtagcgaccatgcaggaagtttttattaccctaaagaaattccatctacttcacctatttcactgtcctccttggagagtccctagttagcattaatctgtttactatctctattattttacctttcccagggtgtcatatacatggaattgcacagtctgtcatcttttcaaactggcttccttaacttaaaaatatgcctttaattttatgaagtatatcttacggtgatttagatttgcattgctgaaggactaatgatgtcaatcatctttttatgtgccctttggggatacatattctttgaagaaatgtctatttatacaatttacccatttttagttggtatttgtcttttattttttgagatgtgacaatcttttatatattctgaacagtagaccctcattacctatatgactagcaaatattttgtctcttttttttttgagacaaagtctcgctctgttgcccaggctagagtgcagtggtgcaatcttggctcactgcaagctccgcctccccggttcacaccattctcctgcctcagcctcccaagcagctgggactacaggcgcccaccaccacgcctggctaatttttttgtacttttagcagagacggggtttcaccatgttagccaggatggtctcgatctcctgacttcatgattcgcccacctcagcctcccaaagtgctaggattacaggcgtaagccaccacgcccggccttttgtcctctttttagggttgttttatacttcttgatagtatatgttgaatgacaaacattttaaaaaatagatgaatttatctatttttgcttctgttacttgtgttttttgtgttatatcttagaaaccattaatttcagaccatgaagatacatttttaaaataactttttttttgagacatgagtatcacttttgttgcccaggttggagtgcagtggcacaatctcagctcactgcaacctctgcctcctgggttcaagtgattctcctgcctcagcctcccaagaggctaggattacaggtgcctgccaccacactaggctaattttgtatttttagtagagacagggtttcaccattttggccaggctggtctcaaactcctgacctcagatgatccacccacctaccatacccagtcaaaaatacatttttttttggaaaatatagtttaggctgggcgcagtggctcacgcctgtaatcccagcactgtgggaggccaaggcgggcggatcacctgaggttgggagttcgagaccagcctgaccaacatggagaaaccccgtctctactaacaataaaaaaattagctgagtgtgatgaaacatgcctgtaatcccacctacttggcaggctgagacagcagaatcgcttgaacctgggaagcagaggttgtggtgagctgagatcccaccattacactccagcctgggcaataagagtgaaactccgtctcgaaaaaaaaaaaaaaaaaaaaagctgggtgcggtggcttacgcctgtaatcccagcactttgtgaggctgaggcgggcggatcacactgcactccagcctgggtgacagagcgagactccgtctcaaaaaaaaaaaaaaaaaaaaaaaaatagttttcctcattgaattgccttggcaacttttgcaatccatagaccataaatgtcagggttaatctttggacagtcacttatattccattgacctatatcactgtccttatgccagtaccacaatgtcctcattactatcactttatattgtttagaaatcccataatccaactttgttctgcttctcattaccagtgtggttcttttagatctcatgaatttccatatgaattttagaatcagcttaccaattactcccgccttgcccgcaaaaaaaaagcaacagggattcccatagcacaacgacatcactctgctggacagcaagagggtgtgttcaggaaccatacctagtctacaaagccatgggactacataccacagtcccagggacaaccacaaaatcaagactcttcttttgtttttgtttcttttttttttttttgaaacggagtattgctcagtcacccaggctggagtgcaatggcacgatcccgactcactgcaacctctgcctcctgggttcaagcaattctcctgcaaatattttgtctctctttttttttgagacaaagtctcgctctgttgcccaggctagagtgcagtggtgcaatcttggctcactgcaagctccgcctccccggttcacaccattctcctgcctcagcctcccaagcagctgggaccacaagtgcccaccaccacgcctgcctaattttttgtatttttagtagagacggggtttcaccgtgttagccaggatggtctcgatctcctgacctcgtgatccacctgcctcggcctctcaaagtgctgggattacagacgtgagccaccgtgcctggccaactcttctttttatggtctgaaatcacggagtatattctctacatctcattcctaccttcaatgaggaaattagttcctgggatctgatgacctggagtgagagatgcagctgatctagaccacatttctcacttctgagatcagaatagcaaatatgtatgtactagtaatttggacatttgcaattcaagaaacctcgcacctcccacagcatacttcattcactccatgagaaaaaaacaaactcacttaaatattcatcttcagaaaaaaaaaaaaaaggctgcccgctgcggtggctcacgcctgtaatccactttgggaggccaaggctggcagatcacgaggtcaggaaatcgagattatcctggctaacacagtgaaacctcgtctctactaaaaatacaaaaaattagccgggcgtggtggcaggcgcctgtagtcccagctacttgggaggctgaggcaggagaatggcatgaacccgggaggtggagcttgcagtgagccaagatcgcaccactgcactccagcctgggtgacagagtgagactctgtctcaaaaaaaaaaaaaaaaaaaaaaaaggcagagtggcagaccaaaaacgagccatatgtcaatctggagtaggagtgaccaatgtcagagtggaaaatgagggctgatgagctttggttctcaggctttagagtaaaggtggtagatgcaaaactgtctatccaccgtgggtttatactgataagtgggcagtaaatgaaagaatagtgtaatcagctgatgttagagtgcaccttttaacaacgttcaagtacagatgcatcttaaaattgacattgtaaaaacaaagtttgccagaatctagtcataatatggctgtccttgtctgcacatgcatgaacttgatctgaaaacctttgattgacgtcttctggtgatatgatcaccatcaaaacttacagagatgctgtcagtaggttgaataatctcataaataggagagtaggactctgtcaagaaatgtgatgtcaccaaagttcctgattagcaaagatgatgacaatgtggggtaaatcatggacagggtgtgttgaaggtgattcagaagagtttgatctgagtgacaggaattttaggaatgctgttgttagtgtattctgcttatattttccatctttgtcatcatagaagtgatataagactaatacctgcatttatagtagttgaaagtttttttcagtaataatataaaattgtaagtgataagatgtatttgtcctatagtctacgaatttattcctatattgtgacataaaataatgatgcattttacaattgactcaaataataactatttcaattccttagaaaacactgtatgagaaaatgctgacttcatgtttagtatagatgtgctattagtctacaggttttaagtattattagttcattcaattctcacaacatttcaagaggtaggcaatattaccactcccaagttccagttgtgaatctgagctaaagccttacaggaaaagagtagaaaaacctgagcttgactttgtctgtctccagaatctttgtttacatcaactatgttagaatatcttttctatgataaatacatcctaagtctagtttcagaaattgtgctttacacaatagtcatgaaattatttttctcaatttcaatctaaatgctacattaaatcgtttttaagttcaggtcaatgaaccatctggtgatcattttgtatgtaatgtgaggtcaaaggtgagatttttattccctcccccaccgcaacagaagaatattcaatttcctagaacattgatagaaaaatcaattttccccccattgaactttaatatgtatgtataagagttttccactgggcatggtagctcacacctgtaatcccagcaatttaagtggctgtggtgtgaggactgcttgagcccaggagtttgagaaaggcctaggcaacatagcaaaacactgtctctacagaaataaaaattttaggccgggtgcggtagttcatgcctgtaatcccagcactttgggaggctgaggcgggcagatcacctgaggtcaggtgttcgagaccagcctggccaacatagtgaaaccccatctctaccaaaaatacaaaaactagccagacatggtggcacatgcctgcagtcctagctactcgggaggctgaggcaggagaatcgcttgaacctggcaagtggaggttgcagtgagccgagactgtgccactgcactccagcttgggcagcagagtgatactttgtctcaaaaaaaaaagaaaaaaaacaaaaaaaataaaaattttaaaaataaggagtgttcaacactctttctacttgctaacacttatgcaggttcaaatcttgccttttaatatttgtttttaatttgtcttgcagactaatgtctttatcacttgtgtacattttttttcctttggccacataagtatcatctacaacccaaaatacatttctcctttatttaaagcacaagtcaagcagacgttcaacaaataggcaataaaaatcagattaaagatactgtaggtccaggagctgtggctcatgcctttaatctcaacactttgggaagctgagatggtggatcacctgaggtcaggagtttgagaccagcctggccaacatggtgaaacgtcttctctgctaaaaatacaaaaattagctgagtgtggtggcgtgcgcctgtaatccaagctactcaggaggccgaggcaggagaatcgcttgagcccaggaggcagaggttgcagtgagctgagattgctccactgcgctccagcctgggccacagagcgagactccatctcaaaaaaaaaaaaaaaaaagatgctgtagtaggaaatgtgcattactctgttgaaatccacaaaatgcatgagcatacaacccaaatttaagtggtaattgaaggtttcctcgaagaggcagtttgtgattgaatagatgaagaataagcagctgaaaaccatgtaaattagaactaataaataacaaaggatgattagtattgaggtagagaatgggaatgtatagaatgcaaaaaaaattgagacatcgcaaggagagcagcaatttcagtacacttgaaggaagctagaaatatataccagggctagatttttaagatatttaatgccgtgtcaatgtgttggtattttataattttctgtagttccagacattagctagggtgtgctcacttaggaacacagctgttgaaattgtaaaatgagaatttgggtctcatacatttgaagaaaaaaatatatggggtttaggttcagattctgtacagacaaaggaaaagtatgggtggggaaaatgtgagacagcctgaggtccaggaaaaatggccacagaaaattttcgtattttcagataaaatctactcttcaagttagacctccctacgaaagatgctagttcaataatgaattctccacctggaaaaggacatttcagctccaagtccaggttgctttcatgccttaaagtcaccttatttgtatttcagaagcacgtgctacactagctttagggaatgaagaaccatgtgctgacagtgccatctagcatcaacagaaacaggaaccaatggcaacctaaataagtacagaaaaaaaggtggggtccaggaaccaagaatgactgctgatttgagcaggatttttacaatttgttttaaaacttaaacataatgcatagatgctgtggaattaaaaaatgcaacctaggccgggcgcggtggctgacgcctgtaatcccagcactttgggaggccaaggccggcggatcacctgaggtcaggagttcaagaccagcctggccaatatggtgaaacatctctacaaaacacacacacacacacacacacacacacacacacaaacacactagccgggcgcagtggcgcgcgcctgtaatcccagctactcgggaggttggggcaggagaatcgcttgaacccgggaggaggatgttgtggtaagccaagatcgggccactgcctggcgacagagcgaaactccgtctaaaaaagaaaaaaaatgcaatctaataatgtccagcaacgatacagggaagcctggcccatgctcacttttccagtcacctgctcttaagtagtgcacgggttaaagaacgatgtgagtgctagtggctgattctttcacttacaaacatgcatgtacacgattgtgttaccatggacaaacacataaaatttgattgtaaaactagttgactcttaactgtgacacattaaatccttgagtaaatgagtgtgtgtttccatacatatattcagtaccactacagttcacaaaatgaacgggacttcttaggttaaagccttgttaagttattctttaaaacgctttccaatctgatagagagctctggcgtattcgctcaagtttccgtggcgggtctagggctcctgaagccccacgggtctcactgctacccacatggctattaccgcaaccaccgctgccacgcagcccgcaagaaatgtgccaccgttctgagcggccgacaaacccgcagtgcgctacgggaaggtcacctgacagttggggagaacggcagcccgcaggggccgatcttcggcgcgcctgcacagcgcaggcggaattggggcgccttttctccttccggtttccgtttccgtgcgccccgagggtctgttccgcttatggcgcccgccgggagtctccctttcttcgcaagcgttaacctgcgttttactcgtaaaaatttgctttctaggcttcgtataattgttctggtcttgcactttatgtgtgcattagccttgagtttgcttgttgttttcccatgaaaaattgtattgtatttctgtaacagcccctcctcttgttacataaacattgaccagtaattgtatatccttccctctcaatattaacaattttatcttttttgcgttctttgaaaaaaacgaaatccttttcaaaaatactgaacttgtcatttttaagaaatgagatactactttaatcatttctgtattgtccttaagattctttatatattctttattgtttatcttttccactaatatacctttaatatgagaggacttgtagaggcttcagggtcacactttcgaaacccagagttttagtatctccttatagaatatttgtaatttaagaaaaattatacaaggttgaattttcaaaaatatatttttaaaatatatttaaaaaagtatttttaaatatagtcctccggaatgcaaaaggacaatactactttcagctagtactttttaagtgattattttccgccacgtattcttttgaaattatgcatttaggccgggtgcggtggctcacgcctgtaatcctagcactttgggcggccgaggcaggcagattgcctgagctcgggggttcgagaccagcctgggcaacacggtgaaacctcgtctctactaaaatacaaaagaaattacccgggggtggtggtgttcgcctgtagtcctagctactcgggaggctgaggcaggagaattgcttgaacctgggaggcggtggttgcagtgagccgagatcccgccactgcactctagcctggaggacagagtgcgattctgtctctacaaaaaaaaaagaaagaaagaaattatacatttaattgaagctcagaaaatatatgtgtgatgttttctatgaaatgaaacattgtttagatgagaaaataaatgtaaaatgcatttgccttttcaaagcagcaattagtggcgaagtgtgaatacaaaaccagtcttctttctgcagagaccatgtctgtcacccttgtgctggaatgaacaacatcacatatttttttgtttgcatatggcctgagggtcaaattctgcccagcatgtttgctttcttttttaaataaatatttattggaacacagctatgctgttcatttttgtattgccgatagctgccttaatgctacaatggcagtagttgcaagagacagaatgacccataaaaccaaaattatatactctctagccttcctatcacccactgttctgtctggtgttggggcaattcagtctttggtatgctaatttggatgagattcacacttgggctgttggagaggagtgggtgaacctgttgagttaatcagcaactccaagaggtccatttcccaagcatctttccttccataacttcacagtaattttcgtttccttatgtctcctctggccaatatttttctacttctggggtaggcggtcagaggaaagagaaaaaaaggaaaatggtgaagttggacccactgtcttggacctatgacgactcctggcagagaaaggttttcccacttttcgtttttgttcttgtgaactccctgagcagccactgtcatgacaacatgatggtctgagaggtggagtagaagagattggagaaaagggcgacagagtgagaccttgcctctaaaagaggggggtggtggtggagggatgggaggaaagggggattcttcactcttgagttccgttttcaatcctcgaacttttcctggagcccgcagtctgcaccacagcctcacttctgggtttctgcctgtcttaaattcaggcctggggataagtgagtggtaaaaattaaaattcatcaccaatttagtagtacttcacagtccagtgttattccttcatttctgttactacttagtcctcaaacagctgttccatacattttatccaagttttatagctatattcagtaggagagacagggcagaaaatactttttctttcctgaaaatggaaccctaatgggagcctgatgaattttttaattgaagccaaaataaaaaaattaatatgtgctcataaattcatatttatactcataaaatatgacattcaacccaagttcttcattttaacacttacgcctttttttttgagacagagtcttgctctgttgtccaggctggagtggaatggcatgatcttggctcactgcaacctctgtcatcagcgttcaagcaattcttgtgcctcactaccgggtcttactacattgcccaggctggtctcgaacttctgggctcaagtgatcctcccgccttggcctcccgcagtgctgtgattacaggcataaacctctacaaattttaatctacaaaaaacaaaattatattcgctttacctgtgtgacatttgaataatgacggtccatgcaggctttacatttcacttttatgaactaaaaaaaaattgagcctccacagggcaagtcctctgctgtgcatggaagataggcaggtgttcaaagcatagaaaggtactgctgccccaggtaatgcagtcaagagggaattcaagcatatggaggtgattttcattgctatcaagagtgtggtttaaaaagtcacagtaagggctggatgtggtggctcatgcctgtaatctcagcactttgggacgccaaggcaggtggatcacctgaggtcaggagttcgagaccagcctggccaacatggtgaaaccttgtctctactaaaaatacaaaaaaaaaacaatgagctgggcatgggggtggacacctgtaatcccagctacttgggaggctgaggcaggagaattgcttgaacctgggaggcagaggttgcaatgtgctgagattgtgccattgcactccagcctgggcaacaagagcgaaactccgagagagagagagagagagagagagagagggagggagggagggagggagggagggagggagagagagagagagagagagagagagagagagagaaagtcacagtaaggcaccctagcagagtgaaacaaaaactaaaaaaaaatcgtgttccagcataggcctgagcatttaaaaatcgaagaaccgtggaaatattaacaattacataaagtgcatctagattttgaagtcatttcatgcaatattcatgagttctgggtttatcagttattcctcagctttatttggtgtatcagttttaggaatgtgtatgtataatcgtcaagtcttctatctgaaaggtaccagaacaaagcctggctttaggatcagatcctgggcaggcaaaagagcgctagaggcggaacaagatatccttcctatctgaagtggccatgggttttcaactgacagccttctcctcatccacttccaccttccccgatgctctcagaggtagactatgaaggcctctccctaaccactttctagctgcctcttcatatccttagtgtatcatttctccaagctgtaggtgtcctgctaattgattttgaatttttatgttcttctgtgtgcgaatgattaaatattaaatacaaaagtcggttcatttgtttgttttttccaggcttgtaatctctaactttcatttttgctacaaagcctttaaaaaaaaaattcagttactctagattcagattttaattaaaatttatttttgaaggtaaacatcttacataaaatttggctaaaagggaagaaaaaaaactacctaaagtttatgtggtcatcctacttgcaatattttagcaagcatgatttttatttaatgagtttcaaaaattttgacaatgaatactatcacagagactaagagtgtgtgatttcttccactttcatagcacagatgctcctcgacttacaatggggttatgtccccaataaacccatcataaattgaaagtatcttaagttggccaggcacggtggcttacgcctgtaattccagcactttgggaggctgaggcaggtggatcatgaggtcaggagttcgagaccagcctgaccaacatggttaaatcctgtctctactaaaaatacaaaaattagctgggcgtggtggtgcacatctgtaatcccagctactcaggaggctgaggagaagaatcgcttgaacccaggaggcagatgttgcagtgagccgagatcataccactgcactccagcttgggcgacagagcgagactccatctcaaaaaaaaaaatatatatatatatagtgagttgaaatgcatttaatatatctaatctattgaatatcattgattggcccagccttgagcacttaaatttgctcaaaacacttacattagcctacatttgggcaaaatcatcaaacacaaagtctattttataataaagtgttgaatatctcatgtaattcataaaatactggaagtgaaaaacaatggttgtgtgaattctcaaagttcagtttctactgaatgcttatcactgtcacaccatcataaagttgaaaaattgtaagttgaaccatcttaagttggggactatctgtactgtgaaattccaacttctggacagtcaagaaggaagccagtaaaatcagaaaccagcggctttgcagccaagtaagcagggaggccaagcgtattccttggatggtctgcggtgggcagtctctgccaggatgtgcccacttagcacacacagccctgtacatcagcctgcaggaaaggcaccttggccagagcctcgggctcaccctagagcactatagaaaggtcatctggctgtctgggaggacagtagcccacaggggctgaagctgggcacacccactgggtggctcagggccagttttataatccctaccccctcaacaaacacactccactcttgaccactgcactccaacctctgtccctgcatcctccaccaggctttacacctgcaattgcactttggataataacaggcatcattggcaatatcttacactctatcatttcagataaagccttgaaaaatatgtgcaattatatctgtgcttctttgtggatatatgttttattatattcactatatgattataataatattagttactactagtatttatcaagaatgtagggctgaagctgggcacagtggctcatgcctgtaattccagcattttgggaggctgaagcaggtgtatcacttgaggtcaggaatttgagactagcctggccaacatggtgaaacctgatctctactgaaaatacaaaaattaaccgggcatttatgcctgtagtctcagctactcgggaggctgaggcacgagaattgcttgagcctgggaggtggaggttgcagtgagctgagatcgtgtcactgcactccagctgggacaacagagccccactctgtctaaaaaaaaaaaaaaaaagaatgtagggctgggcatggtggctcacgcctgtaatcccagcattttgggaggctgaagcaggaagattgcttgagctcaggagttcaagaccagcctgggcaacatggcataaccctgcctctacaaaaaaaaaaaaaaaagatctatatacacacacacaaatgccaggcatggtgacacatgcctgtggtcccaactacttgaaaggttgaggtgggaggatcgcttgagcccagaaggtcaaggctgccgtgaggcatgatggatccacggcacttcagcctgggtgaaagagcgagaccctgtctcaaaacacaaacaaacaaaaagggtgtagtatattcctggtattgattgtgcttttcatagtttaaaagtaagacttggtgtaaaggtatgcattgtgtagtataaatgcacagagaggaaaggagagattgggtacaaattcaggaaggcatgaagtgttgatgtcatgacacttagcccatccttgctctgcacagaccacgtttctcaccactgtgctggtatgtagacaccagcatgatcttctgaagcctcggataatttggtgtggatagctttcttttggattcttttaaattttgttatcttaaagctttccatagtatttcatatggataggccacagttactttccatttactattatacttttatatattttttcttattttgatatgagaaacaatgttggaataatcatgcctagacataaataagccaatttcaaaatgtttgtaggggagactcatagtgttgccagaaaaaggggccctgacccagaccccaaaagagggttcttggatctctagcaggaaggaattcaaggcgagatgcagagtgcactgaaaagagagagtttattgaaagctactcagctatagagtagagcatcctcagaaagcaagaggagaaatgccttgtatttaagttttttttatgtaagtgtcttgtctatgtaaagactaaactaagctgtgtctacgtgcagatgggttgagagcatgacaaaatttactattctgttgatttaaagaaaatggtccttgacattttagtaagtacatcaaagccataactgtaagtaacttgaaagcatatattgttatgggtattgggacatctggattttgtgttgttgtaggagtgtatccttgcaccggtagcctaggtattgttaagctgtttcctcaattataaacatgactatgggttgtgaccagcaaggaatgtgccttagttaatctcaagatggagctgaacttaaaatgccattactttggctctaaccagctcctgcttccataacagtggggtcaaaaggtgttcctttaaaatcttcctagacactgccaaattgcttttggaaacttctcacctggtgagatggcatgagtatctttggctcatttttctacatagacttggaaacagttttatgtttataaaatatgtatcacctcatttataaatttgtttgaataatttaaccattttgcttttattagctattttgctactctctgttttccttgcctgagtctttcccacatctctgcaacattgtatcatttcccacacctaaaaccaaagagggacaggcaagccagtggagagagcagaggctgatgagaacgaaggattttccaggaaggaatctggggctgtgtgtgtgtgtgtgtgtgtgtgtgtgtgtgtgtgtatgtctgggtgtgtgaatattgtttttattagcctgtagcccacgtgttgcatggccatatttttactatcaggatataaaacacacttacacacagctgcatacaaatgcaatgagtttatttttcatatacatttcaaaataatagcgtgaacagaccagaactcttcttcaaagttcaagaatgtcctcatggatccagcatccgtctggtttctgtttctgcattctcagtacatagcctcacttctctttctccaattttggaggatgtgtaaaaaattttattcttaaccaaacattagtcaggctccggaacgttctcttaactccatccatgcactttcttgtaaaatgcagttttaacaagaacactgctaagttagtttagcaagacccccacaccttagacatctgatcaccttctatatcttatcaggttcctcatcctccaccatcccttaagtgatcatcccagcttgtcttcagcaagaatcctattagatcaatttagccagaatccctcttgcccctgatgttaattcttagtaattttccaaccactagtccccaccctgttccttggctataaattgccacttgcccatgctgtacttagagttacttagagttgagtctcactctctcccacactgcaaggccccattacggcggtccctaaatctattgcagtggtcccgaataaagtcttccttactatgcattaacacgtatcattgaatatgactttttctttaacagatactttgacgaaggtaattgggactcccatcaagtctccacacagctagcagccacgtggggcacttctccaggtaaggattgtccctgttccacttatgttcctgtcagtaaaatggtaggttcagtgtcaggctttaccattttcttcagggagagacccatctgatatttagtcagccatcagatgggtccagccatagcacacattagctgtgacatgacgtcgtttatgacaatgactttgagcagagttgcacacctaaaaagggactcaattaaaattatcattcattttagttatttctcagatgcatttattatttccattttccaaaactcctaatgttacatttcttcttcacatgttagatatgaacaaagtaagactaactgtggccacatcctctttacttaggaccctacccaaagtggcaggaatgggatgtaaagtgacataatcagacacagtcaaactggcttttaatcgttaagtatcattgtcatctcaaagcacttggcatagttactgaccccttaaatgtcctttctccatcttatcttctcctttgttctctgtatcatcttccggtcctatagaaatatatccccacgagcacacactgaggtctttttttttttttttttttgagacggagtcttgctctgttgcccagactggagtgcagtggcatgatctcagctcactgcaacctctgcctctcgagttcaagcgattctcctgcctcaggctcccatgtagctgggattacaggcatgcgccaccatgcctggctaatttttgtatttttagtagagacaaggtttcaccatgttggccaggctgctctcaaactcctgacctcaggttatcctccggcctcggcctcccaaagtgctgggattaccagcatgagccatcgcacctggcctcactgaggtcttaatgctgagttgaactttgtctctggccatgagcatcagtccatgtattataataggtttgggttgggtgtggtggctcacacctgtaatcccagcactttgggaggccgaggcaggctcacaggtaaacaatttagacaaagttttcacattctctgagatttgtatacattggagattcagaaaaatgtaaccgaaaattaaactataggtggaatagctgcctttgggggctgagaagacaggcatcagacctgggatagacaagggaggcctcttgttccttgaaatgataccccagcccatgaggtctgcatgccaggaagccaaatgagtgaggatggtctgtgtccgctggggaggtccctggatgttgccaagagggatagggtctgggaaagagtgaggatggagtcaggcagagaggaccccccaggctcatggatggactgacctgaggacttatattaagtcataggacagtagagaaagtaagagccaagcataatgtaatcctaacaatgtaaaaagtattaatcattttattattagttaatgtcactgaactgtacacttaaaatggctaaaaaggtaaattttaggttacatatattttaccgtaatataaaatgacaaatatattagaaatgacttttttttttttttgagatgtagtcttgctctgttgcccgggctagaatgcagtggcacaatctcggctcaccacaacctccgcctcccaggttcaagtgattctcctgcctcagcctcccaaatagctgggattacaggtgtccgccaccatgtccaactaatttttgtatttttagtagagacaggtttcactgtcttggccaggctggtctcgaactccagacctcgtgatccacccacctcgggttcccaaagtgctgagattacaggcgtgacccaccacgcctggccaggaatgactgtcaactatattttcttaacatatgtattcctacacaacatcagttttgtaatagtttatttttgttttgttttgcaatttttttcttttattgtaaggaaagaagtacattttttcagcgtgtaagaatgcaaaagtaattatcagatgtttgtcacatcttaacaaaataggaccttattttcctagatgttgctgcattcagtccctttcttggtatggtaaaagcatcaatcagccagggaggcaactataaatacagaagagcagtttcctacagatagtcaaccatgctacccctcttactgacttaattttaatattggagcctggcacaattaacctagtttcctcgtaaacacaagaacaacgtactgcaatcaatgtaggcatatacaggctcttaaagttctgagaagcagcaagtaagttcatcatttactaagatccttgacattcttctgtttctgtgaaatttatgcatctgtgagaagtttcttttctttttttatttttttttgagacagagtctcgctctgtcacccaggctggagtgctgtggcacaatcttggctcactgcaacctgaacctctggggttcatgccattctcttgcctcagcctcccgagtagctggaactacaggcacacgccaccacacctggctaatttttatatttttaatagagacagggtttcaccatgttggccaggctggtctcgaactcctgacctcaggtgatccacccaccttggccttccaaagtgctgggattacaggcgtgagccaccgtgcccagctgagaagtttcttatactagaagaaaaagaaaatttgatttattttaaaatataatggtttagtctgtagcaagtaatattaatttttttatttttttatttttgagacggagtctcattctgtcacccagactggagttcaatggcacgatctccgctcactgcaagctccgcctcccgggttcaggccattctcttgcctcagcctcctgagtagctgggactacaggcgcctgccaccacgcccagctaatttttttttgtatttttagtagagacagggtttcaccgtgttagccaggatggtcttgatctcctgacctcgtgattcacccgcctcggcctcccaaagtgctgggattacaggcatgagccaccgtgcccggccctaacacgaattcttaagagaggtgaaccagggatgggattgtggatcaatcatgcaaagaccgactcctctgggcttcatttcctccatactgaatgtgcatccctacatgttcatgttgttgtttcataggtagtgcagggggtcagaataggatacccctggctgggtgtggtggctcacgcctgtaatctcagcactttgggaggccaaggcaggtggatcacctcagatcaggagtttgaaaccagcctggccaacatggtgaaaccccttctctactaaaaatacaaaaattagccgggtgtggtggtacacgcttgtagtcccagctactcaggagactgaggcaggagaatggcttgaacccgagaggcagaggttgcagtgagctgagatcgcacctctgcactccagcctaggtgagattgaaactccatttcaaaaaaaaaaaaaaaaaaaggatatcctcaattgcggtgccctggcatactgagtattttaagctgaaggaaattgagaaaaccatggaagcaggaaggccactctctgatttgctcccacttttctcccctgaagcaggtcataaaagaattatctgccctacctgtcctgaaagtaggtcataatgggaccctcatttcagaggagttctgccctatccctggataccaacaaagatctgaacaaacaggtcttatgaatttctccccaggtaattactattagatgataccctttgttccccaaagctatttcttcaaaactgtccataaaaatacacctatccagctgggcacagtggctcacacctgtaatcccagtactttgggaggctgaggcgggtggatcacgaggtcaggagttcaagacaagcctgaccaacatggtgaaaccccacctctactaaaaatacaaaaaacaactagctgggtgtggtggcacaagcctgtagtcccagctactcaggaggctgaggcaggagaatcgcttgaacccaggaggtggaggttgcagtgagccgagatcgcgccattgcactccagcctgggcaacagagcgagactctgtctcaaaaaacaaaaacaaaaacaaaaaaacaaaaaagccccacctatcccttggcctttgcatcttgatttctgaagactcacatgtcatgtaaaacttacgttaagtaaatatattatgtttttctcttgtaaatctgtcttttgtaatcaggatctcagccatgatgcattttggcttgtcagaaataatcacaacatgtggagaaatagataaaatgccatttttaaaattattattattttttatttttttgatagagtctcgttctatcgcccaggctgcagtgcagtgtcatgatctcagctcactgcaacctccaccacccaggtccaatcagttcttgtgactcagcctccccagtagctgtgatttcaggcatgcaccaccacgcttggctaatgtttgtatttttagtagagatgggatcttgctatgttggccaggctagcctgaaactcctggcctcaagtgatctgcccgccttcgcctccttaaatgctgggaatacagttgtgtaatggtatttttttttgagacaaggtctcaaaatggcattttttttgagacagggttgttgctctatttaccaaagactatacaagattatgtgaacttaaaataatattcgggttaatttctgtatttctaagttttaggaatacttagttatgtaagcatttacttccctttaagtcaattaaatcctcttttaaggaactttataaattaatttggtagtatcattgggcccagtagagttttttttttcttttttttgagacggattctcgctgtgttgcccaggctggagtgcaatggcgcaatctcagctcactgcaacttctgcctcctgggttcaagcgattctcctgcctcaccctcccaagtagctgggattgtaggctcccgccaccatgtccagctaatttttgtatttttagtagaaatggtgtttcaccatgttgatcaggctggtttccaactcctgacctcaggttatccaccctcctcggcctcccaaagtgttgggattacagggatgagccaccacacccggcaaatttcttttaagatattttataaattaatttggtaataccatcagaggcagaaaaatttcacacagatggagagacatacataaacatacaggcaaatatcaaaagagatcttctagctatcattctaaaatcttagccatgaatcagaaacacatagtaatacaaagtcactgttttatatgtaacagttatctctcatattttctccatttcatattttttccctattgtccctggtaaatgggacaagttaaggctatgtactaaatattaggcctaatgctttttaccaatattcatggagaaggtttttaagatcttcatttgccctgtgaagcccttttgaaggctgtggactaaatgttaaatgagtcactgcaaagacatctaacagctatcgaaatgtctccaccacccatctgagtggataaaatatccagtctatttccaaatagtctttttttcctcttcagccttggtacttacttttggaggactctgagtcccttgacagcagggtggactaaagtttaagagaagaagtctgacaggggaggaagacagagagatggagaaggtaggagtttgaagggatcatatccaggactcaaaggaactgaatggaagattgaaagtggcaagagtaggaaggaggaacagaaagagggggaaggaagaggtcttaagggaaccagctgggggagatattaaattccccaaagaggctagtgaagctccaaattatccttagcaaaatcaggccgggtgtggtggatcacttgaggtcaggagtttgagaccagcctggccaacatggtgaaaccctatctctactaaaaatacaaaaattagttgggtgtggtggcacatgcctgtaatcccagctactcgggaggctgaggcaggagaatcgcttgaacctgggaggtggaagctgcagtaagccaagatagcaccactgtacttcagtctgggtggcagagtgagactccatctcaacaaataaataaataaataaataaatatccttagcaaaatcatgccaaaaagagggaggtaggcagaattgtgaaagcttatagccaacagaggttcaagaaaaggctttttgtcaatggataagtttacatgggaagatccggatcaaaaggagagaacagagaggacttaagaaaattgttcctattggctgggtgtggtggcttatgcctgtaatcccagcactttgggaggctgaggcaggcggatcacctaaggtcaggagttcaagaccagcctgatcaacatggtgaaaccccgtctctactaaaaatacaaaaattagctgggcatggaggtgcacgtctgtaatcccagttattcggaggctgaggcaggagaattgcttgaatctgggaggcagaggttgcagtgagccgaaatcgagccactgcactccagcctgggtgacagagtgagactctgtctcaaaacaaacaaacaaacaaacaaacaaaaacagaaaagaagaaaagaaagtttttcctataagtctgtaactatcagcttcccattaggccaactattgatcatagaggtcttaaaaaatcctttcaggctgggtgccgtggctcatgcctgtaatcccagcacattgggaacctaaggcggtaggattggttgagcccaggagttccacaccagcctgggcaacgtattgagacctcatctttactaaaaataaacaaaattagctgggtgtggtggcatgctcctgtagtcccagctactcgggaggctgaggtgagaggatcacctgagcccaggaggtcaaggctgcagtgagctgtgattgtgccactacactccagcctgggtgacagagcaagacactgtctcaaatatatataatttttttcaaatatcttatcaggttttggtcaagaggaaaggtaaatattcctgatagtacattcccattaaaaaaaaatgtacccgttacaagtgacttggaaccaaaatccatagattctttcatggttctttatcggtatggtgatagggttttcatattcatgtgtgagatgtgcctccctcagtccttgttatgacatcattacgtgtctgacatgacaaaaaggaaaagagaaaaaggtggagaaaggtaaaaaataggaaaagaaaaactgaaggaaaaaggaaaaaaacccaatccgtaagccttttatgacttacccatgaatgcagaggcatcttcaaagagggtgcaaaaaatgcagccctctaaagatgccaaaccactctcaaagatagccaaaagaaaggcaggcctagatactccccctgagagctggcaatagatgttagctgcaaatgggttgcaacccacatgtctgtccagctgtattcccacagccccccaacctgatggttggctgcttgcacacacaagaaccaacaacttgtacgccccatcaagtggaaaaccaagccaaattcttttttttttttttcctttgagacggagtctcgctctgtcgcccaggctggagcgcagtggtgtgatctcggctcactgcaagctctgcctcccaggttcacgccattctcccgcctcagcctcccaagtagctgggactacaggtgcccgccaccacgcctggctaattttttgtatttttagtagagacgggctttcaccatgttagccaggatgtgtcttgatctcctgacctcgtgatccgcccgcctcggcctcccaaagtgctgggattacaggcgtgagccaccgtgcccagccgaaacaaagccaaattcttgacacaaaatgacagaaacagaaaagcaatagctgctcctgggagggaaaggatcaataaccaataggcaccacaaaatcaagctacagtcacaatctagataatgaatttttataatttttttcctatccatctgcattgggaaaataagggacaaggagtttttactttcttctcttgaccaggaactactgacagagatctgggagagctgactttggtgaaaattctcaccttgcacaggcttgtgtctgttttccagaatcctacctgcagactccagaatgaagtgtcccagctgtccctttctcgttgccagaaacttctacccttctcattcctttgcttgtccccctgtaacaagagacagattaatgagagaaaatcatgcaagttgatttactgtatgttttatgtaacatgagtcttcataagaaaactaagcccaaaagaagcagttaaacctgagtgttttttttgctggtctgatgaagagcgaagagtcatggagaaatgtaatgggaccaaaaggtgtcagctaagtgtaataaactgggggaaacagcaagggctattccttcagattcctctcagtgtccctgtgtcttcagagataaagatcttttcctctgggtaaagcgtggcagctctcacatgagggttttattacttgcttcagcagaaagtcaaaaagcccttcccaggttttatgacctctttcagcgaaaggtgagaaagtccttcctacacatttggtttctgaaattccttcagcttaaaatattcattatgccaactttccatattttgggttggcatgtcctgaatatattgtcagagcattacagaaaaaatacacccaaacacacacacacacacacacacacacacacacacacacacggacaacacattccctatgactatcttaaaattgattaacctcaaacatttaattttggatgactgagtcaaaaagagaattgaaattgccatcacatatctggtcaagctgaaagatggcatttggtattggaaattgatggctgctggtcatttaacacccatgcctcagttacatatctggctcatgagataagaatgctaaacagtataaacaagacacctcagtatgaaaacgttctgccgttacaaaggtactctctttgtgttactctgcattctctcccagccctgtagcaatttatcctttgtccatatattgaagatagatttgtttacatctactcttagccttcctgaatatcctttgctccaggagagccttaagccaagggtagaaatgacaagacagactctatgtttgcagaacaccacatagtcacagcgatgcaaatggaaaggaaaatatgagaacaaggtctttcaatccagatttggcctatgtttgtattaaaggtgttattcccatgtaagaccttaagacataatattaataataattcagctatgaaaggttcatgttgagttctacttgcatgggcaagctattaggtagaagttaaagatgcacagaacacattagttctttctaggtatatccttagcagagcaaaattgcaacccaagttagaacaggaaaaacttgatgaagcatgaaattaccagctggtctgatgggagatatgatgtggccctgaggtacagtaggtggtgcctgaagcatggtgacagtagtggaaacaccttagggtgacccacaattagtcactctcattcaattccctttccttgggtgtgggaagaacctgccaatagcatgtggcaaaggatatcgttactgtgtttatgctatgttatatgtcaaaagtgaagatatagtgcagatgtaattaaagaaatcagttggctttgagttcattaaaaggcagaatagcctatgtagacctccccttatcagatgagccacttaaaatggctcctaggcagatcacaaggtcaggagatcgagacccccccgccggctaacacggtgaaacctcatctctactaaaaatacaaaaaaactagctaggtgtggtggcgggcgcctgtagttccagctactcgggagactgaggcaggagaatggtgtaaacctgggaggcggagcttgcagtgagccgagatcgtgccactgcactccagcctgggcaacagagcgagactccgtctaaaaaaaaaatggctcctaggccttccctgatgtcagggaaaatagaaaagactctgtctcttcactgttgcctttgaagaagcaagctgccatgaattctatagccattgtaaaatgaattctgccaacaagcaaatgagcttaaaaagtaacagagtctgcgcacagtggttcacgcctgtaatcccatcactttgggaggctgaggtgggtagactgcttgagcccaggagtttgagaccagcctgggcaacatggtaaaacttcatctctatagtaaaatacaaaaattacccgggcacagtggcatgcacctgtagtcctagctgctcaggaggctgaggtgaaaggatggtttgggtccaggaggcagaggttgcagtgagtcaaaatcacccctctgcactccagcctgagtgagagccagactctatctaaaataaacaaaaacaaaaacaaaaacgtaatacaggccactgacaccttgactgaatccctgtgaaatatttcacctgaaaatccagctaacctgtgcccactgacccacaggaatggagataatatatttacattgttgtaaactgctaaattgactggatgtggtggctcacacctgtaatcccagcatcttgggaaaccaaggtggggggaatcacttgaggccaggagtttgagactagcctgagcaacgtagcaagaccctgtctctacaaaattaaaaaattagccgagtgtggtggtgtgtgcttgtagtcctagctattctggaggttgaatgggaagatttctttagcccaggagttcgtggttacagtgagctatgatcacaccactgcactccagaatggatgacaacgtgagaccttgtgatatggtttggctgtgtctccacccaaatctcaccttgaattataatcccatgtgtcaagggtggggccaggtggagataattgaaacatggggggtggtttcccctatactgttctcttggtcatgaataagtctcattagatctgatgcttttataaatgggagttcccctgcacaagcgctcttgcctgccaccatgtaacatgtgcctttgcttctcctttgctttcctccatgatggtgagggcttcctagccatgtggaactgtgagtccatgaaacctctttctttataaattacccagtctcagatatgtctttattagcaggctgagaatcaactaatacaccctgtattaatgtattaatacatgaataaaaaaagttgctaaatatgtagaactacactctgtgtcttccctttagtgttaggaagatcaaataggcactacaagagcattttcttggtaaatggtatctaaattccctcttatcaatggcaattactcatttggactgctaacaccataggggcaaaaatcctgacatgtatgaatcttgtgggagaagcacttggaaaaaaaacaaaaacaaaaacaaaaaacagagacaaacatttctgagcaaaaatgcaagctttttaaaaaaaatagtttgttttgatcagttcacatcatgtaggtcatttcatccggcctcattggcatataagtagtatatattgagctaggcgtggtggcttacgcctgtaatcgcagcactttgggaggccgaggcaggcggatcacgaggtgaagagatcgagaccatcctggccaacatggtaaaaccccgtctctactaaaaatacaaaaattagctgggcatggtggcgggctcctgtagtcccagctactcgggagagtgaggcaggagaatcacttgaacccgggaggcagaggttgcaatgagcgaagatcgcaccactgcaccccatcctggcgacagagtgagatctgtctaaaaaaaaaaaaagtagtatatattgaaagtataaaggggtgaaccactttgaattgcgtatgacaaaagaagctcagagttcaggtgaaaaatgtgttattacaaactcaactatcaatttaatctgtctttaatgtatgagtcaaaattaagtgttttctgttggggtgatcggacccaacaccaggccgtgggggcgatgaagtcccacggagtcaaaggaatgagaaaagacaagttaagagagaaactgggaccaggggccaatgctagtatggaggctgcgaaggccccaagctctgggaccccatgctatttattggtgatcaaacaaagaaacaggtggcgaggctgtgggggttgaaaggaagtggtgtatcaagcaaatgagctacagctgtgatggtttagcattttctttgaaacatatggctacttgagataatgggagtgctagaagcaaggagccagcaagtctagacacattccaaaggccacaaggggttttagaccctggaccccagacacgttccaagactcttttacattatgtcagacatccaggccctgcctcaaattctctcccaacactcagcttttctcccaacactttctattacaaacatcaacggaaaaatcaatgatctgtttaaaatattgtaaataccatcactatgtttgaagatatgttttaattttttattattcctttaattaaaagaactgtatgccaattaataagctgttgccttttagatcaaaattaatcattcattgcctgctctgtgaaaattgagtcagatacccttaaaaatatattgtgttgcaatagtaagttttttcagtaattgaaggtggttggacattgtaaaaagagattttcctttctgattccactgtggtctctcagccgtttcccatagcatgcatgcctttctccagcactatatttctacagtatgcatgagcaatcctgcagcaacaatggcttttctagcatcaggctcctacaacgcatgacagtcagcagcactagtggtcagccacttcctatatcccctacccttaggtggtttctagtgtagtgcttccaataatatacctacctgtgaacacctttccctggcacctaagtgggaagatttctggaaagttccactggtgccgcacactgtgactattctgtgtagcctctaacaagctctggattgcaatccacttatagtaaataaatgtccacttcaaacattccctcctcaaattcttgtgttttgtctgcctcctgattggaccctcactgaaagaattaatgctggcattgttccaagagatatttccacagagatgaatctgggaggttgtgttggtcattcctttatgtttgggcacattccacagctccttgtcaatgtgcaatgggatactagcaacctatgacatgcagtggtatcacaattaatcaagcaatgacctgtggttgattgtggcaaagtgccaactgaaacacgtgccttgggagcccgagtgactgctgcactgaatgttatggcagtcaagataactgtaaggactgtggggtggaatggattcagttgagggtccttgagtgattacgaacagaaaataacaagcttaggttccttaattctcagttcaagccacggtttgaaaacctgagaacttccatggcgactataaaggaaattcatttgttgtagctgcagggctgatattgttaaatatcaaaaccaagaatgagatcctgaaacttggaatgggtcaggaaacttggaatgggggaatctgtttagactcagttgaaactgaccatctggaaacagaaagtcaggctgagcctttcttaccagtttaagtagcttgtctctattgtttgaagaaaatatctttcccttgcacaaaagctgggttagataccattaaaggggatgcccatttttcttaaagtcccctacaaatcatcactttttgctagtagcatgactagaccccataactaggattgaatagcaacctattcctaagggataggtacacactatgacctgtaggaaacagctacatgcaaaaggaactgtgacatatattggaagaaacctggggaatgttggaagagcattctaaggccgttatactaaggaggacaaaatataacagtagattgggttaattaatctcagtgctattactggggattcaagatttattgtgctgcaggcatgtggctcacacctataatcccagcactttggatgccaaggcaggaggataagatgagtccataaatttaagaccggtttgggcaacataaagagaccttgtatctacaaaaaataaataaataaataatccagtgagagtggtgcacctgtagtcccagctacttgggggctgagatcagaggatcacttgagccctggaggttgagggtgcagtgagctgtgatcatgcaactgcagtccagcctgggcaacagagccagaccctgtctcaaaaaattaacaaaaaaagatttattttgtagttctcctggtagagatctttcatctccttggttagatgtattccttggtattgccgtcttaggtagaggaagagggctcaaacatcttgcttatgtgataactttgccaaagacacaatgtacaatttgttttaaaggccagtgagggatgtaccagtaatcagaatgttttggcaaacagaagactttggtggtagctaactgatcacagggtccctagaatgaaatagatgagaagcatacttagagtattgtttgatctctatatcaagaaaagttccgggtctggtagtcaaatgttcaacagatgcctacctagctttcaaccctaagtcaattcacagttgcagagtgataccacacggaccatgaaaagaacacttgtttgtatgactgagacaaaaaagaatgtcatcgtgttctaccttacctgggaatatgctcaattggtgacaaaattgttgccactctgtgcatgaccacaaaagtaccgcaggtattgattttgaagttacacataaactttagtgagtgggcatatttgcaaatatgtaacctgagaataatgaagattaactatctttaaacaacataaggagtcaacatcagtttctgaagtaaaataatgactaagttaaattttcaagggcaaattcagattccaagtgcacagaacataggaagaaaaggacatgcaaatcagaaaaattcacaagtgtaatgaggcgagaagggacatggcgcaccaattacaaaggaatcagaatgatctgttcatagagttgtaaatggggttgtggaggaagaaatgaggatgaacagataggcaagacaagttcttttccttctatgtaaataagagaaactgagaaattgtaacgtaagacaagatctaatattatttttggacttcagaatggtattgcataaatgcttaattgttcctgatttcgggaggggaaaatggaaatagcatttccgttgcatttttgtgaacaaaatttgagtgatcatgttctttgttgcatgtggtagatggagaggtgaatgaaagattcagctttcttcctgtacttgaggcatctgtgaattgggaattcagacaaacagataagcaactaattctggatataaaatttgtgatttaggctatgcattctactggggaatttcagatgtataggaatgtagttgaaatttaagtggtcagggaatgctatctagaggaagaaaattatgactagagacaagaataaatagtagtaacttaaaaaaatatatatcagggaagaaaaaatggatttttgttccaggaaagaaactaagtatgaacagatgatgaactatttcaggaactgtgtctgcaattcgttccttccagtgggttcttggtcttgctgacttcaagaatgaagccgtgcaccctggcagtgagtgttacagttcttaaagatggtgtgtccagagtttgttccttcagatgctcagatgtgtccagagtttcttccttctggtgggttcgtggtcttgctgacttcaggagtgaagccacagaccttcgcagtcagtgttacagctctcagtccggagttgttccttcctccaggtgggttcatggtctcgccggcttcaggagtgaagctgcagacctttgcggtgttacaagcgttacaagctcgtaaaggtagtgtggacccaaagagtgagcagcagcaagatttattgcaaagagcaaaagaacaatgcttccacagcgtggaaagggaccccagtgggttgccactgctggctccggtggccagcttttattcccttatttggccctgcccatgtcctgctgattggttcattttacagagtgctgactggtccatttttacagagtgctgattggtgcgtttacaaacctttagctagacacagagcactgattgttgtgtttacaatcctttaggtagacagaaaagttttccaagtccccacccaacccagaagcccagctggcttcacctctcagaaccacagatacaaattattttatttacctgaatcaatctgaaagcatatgctggggctggatgttgaggatacttaatggcacattaattctttgattttgtatatgtttagatacattcattagctacagtttgcagcttcctaacagggattccacagatatgactgtaaattgagaattttggtttcccagtgtctgaaaagtggttaacccaaagttttggctttagagaaagagtctatacaggcaaaagcgtagagggtttggcagagaaaaaacaaaaacaaaaacaaaacatcctaagggccaaaggaaatggttgcaaggaaaacggtcaaaaacttgcatcattctcttcatccactcacaccactctatgcaggatcccaaatcagtccttgaatgtttcggcacaggttccattcatgctttccaatggaaacttcatttggtttataggattcaggattgtggaaccatccggtatcaagaaaataaaaggccatgaaaaagtttacagaatgttggtataagcagctgctagggatattactgagttttaatgggagagatagtcccagaaagctggaagaagaaagatcagggccaagcgcggtggctcacacttgtaatcccatcactttggaggcagagaggggcggatcacttgagtccaggagttcgagaccagcttgggcaatgtggataaaccccatctctacaaaaacatacaaaaaattgctgtgtgtggtggtgcacgcctgtggtcccaggtatttgggagactgaggtgggaagatcacctgagcccaggaggtggcagttgcagtgagcagagctgaggtctggccactgcattccagcctgggctacaaagcaaagtcctgtctcaaaaaaaaaaaaaagatcggagcaagaaaaaggaaaaagatgggtaaaaacatagaaacgactaagttcatttcagcaggaatatatttttaaatatatttcaaaactgaaacaatgctatgttttgctgcagtgtgtgagggaacacaattcaggctaatgcacagtaaaaatgcagggaagcctggccccgtaaccacttttaataccacatactacagttaacagttggtgagaaccctattaggctgatttcaattacaaacatggatgtacaggagtatgttttaatggcacacatgcatagttcatattttattagaaaatctgttcaggccggctacagtggctaacgcctgtaatcctagcactttggaaggctgaggcgggtggatcacctgaggttaggagctcaagaccggcctggccaacatggtgaaaccccgtctctactaaaaatacaaaaattagctaggcatggtgccgcgcgcctgtaatcccagctactcaggaggctgaagcaggagaatcgcatgaacccgggaggcagaggttgcagtgagccaagatcgggccactgcactccagcctgggcaacagagcaagactccctcttgggaaaaagaaaagaaaagaaaagaaagaaagaaaatccgggctgggcacagtggctcacttctgtaatcccaacattttgggaggatcacttgagatcaggagttcaagactagccttgccaacatggtgaaaccttgtctctactaaaaatacaaaaattagctgggcatcagctactcttgaggctgaggcaggagaaaggcgtgaacccgggaagtggagcttgcagtgagccgagatcgcgccactgcactccagcctgggcaacagggcaagactccgtctcaaaaaaaaaaaaaaaaaaaaattagctgggcgtggtggcatgtgcctgtaatcctagctacttgggaggctgaggcaggagaatcgcttgaacccagaattcagaggttgcagtaaactgagatcctgccactgcactccaggctgggtgagagagcaagactccgtctcaaaaaaaaaaaaaaaaaattaaaaattaaatccaccaaattagctcaagaacacttccttgactggctcagaaatcccatccgattttaagatagatgttaaaaaataacagggaggaccgggtgcggtggctcagacctgtaaacccagcactttgggaggccgaggtggggggattatgaggtcagcagttcgagaccagcctggccaatatggtaaaaccctgtctctactaaatatacaaaaattaactgggcatggtggcgtgcgcctgtagtcttagcagctcaggaggctgaggcaggagagtcgcttgaacccgggaggcggaggtggcagtgagccgagatcaagccactgcactcgagcctgggtgacagagtgagactccatctcaaaaaaaaaaaaaaaaagacacattatttcattttaataatgttagtcaattttttttgttgtcgatgagttgcgttttgttcattaagaatcagctgtaacatttgttgggacttggtagaagataactgctaggtggttgtagctgccaggcttttaatgagaggagcttagtttagcgaaaataaaagaaaaacaaagattaatatttggaataaactgtaaactcagcttctgagtccagagatcagccagtcaagattgtttagacttgagcttatctttagatggtgaagttaggaaggtagtgacagtctaatgagttttcctagtttacagtttgtatgtctttggtgattacatccagtgttctggtgaacttcctgaggggcccacccagcaacagacacaaaggtgatttatttgaaactgtaggaacgaaaaagtaatatattttcatcacccattacaaggttaacgagtgagactcctataacaaaagacatattaataagaaaaaataatatcaaatgtagttactaaaagtattatgtgacatgggagcttttagaaatgaagatcaaaagaaccagggagaatcctgggtttttttgtttttgtttttgtttttaattgagacaaggtctggctttgtcaccctggctggagttcagtgacacgatcccaggtcacttcaacctccacctccatgggctcaagccatattccacctcagcctcccgagtagctgggactacaggtgggtgccactgcacctggctaatttttgttttgttttgtttttgtagagatggggttttgccttgttgcccaggctggtcttgagctcccaagctcaactgattcacccaccttgacctcccaaagtgctgggattacagacatgagccaccgtacatggctggaaaaatctatttttacagagagctatgcaaatgtgtgattggaaaacaaatgggtatgacctagtggcaataatctgaggagaaattagccagatctgttcagattcttcttggtctctgcgtatagaaaaggactgctcctgagtgaggaatttatgacctactttccggggaggtaggtcagagaattcttttgtgacccacttcagggggaagaggtcaaagactgtgcttcctgcatctattatctcaatttctgaggtgccatatttgggggcattatttacagagactcaagggggtgtaagtgcctattatcagaggtcattcttacggaggctattaacgaaattttaggtgaatggctgagcagacatctagaagttgtcatccagtctatttctaattaggttttttcttttctgacgcaggtagttgattttgcaggatctgctgtcccttaggagaagagggccctaaagttcaagtgattgtgggactggaggagataaaaggctggcaggggagggcagagggagggaggatgaagcagttaggggcttgaagggggaaatatcaaaggaggcaagagaactgaagggtaaaataatgccaaaaaagaggtggacagagttggcaaagcatatcgtaagcagggatttgagaagaggggattcagatgacagagaacatcccaagggagaagcagaatccaatatagagaatggattggtcttaaatagagctgggagtaaaagattcgcagcccaggaagtcagggaataatacctacggaggaaggacttccaggccaagtatccagggaataatccccactgctatggttctaatgatggtgccctctcaaaaattcgtgttgaggccgggcatggtggcttatgcctgtaatcccagcactttgggaggccgaggcaggcggatcacaaggtcaggagatcgagaccatcctgactaacatggtgaaaccccgtctctactaaaaatatagaaaaattagccaggcgtggtggcggtcgcctgtagtcccagctactcgggaggctgaggcaggagaatggcatgaacccaggaggcagagcttgcagtgagccgagatcgtgccactgcactccagcctgggtgacagagcgagactccatctcaaaaaaaagaaaaaaatcatgttgaaatgtaatcttcagtgaaatagtatgttgcccaggctggtcttaaactcctgggctcaagtgatcctcccacctcggcctcccaaaatgctggcactataggcataagccaccacgcctggccaagacactaccttgaaagcacagagtaggccaggcgcggtggctcacacttgtaatcccagcactttgggaggccaaggtaggcagatcatgaggtcaggaattcgagaccagcctgtccaacacagtgaaaccctatctctactaaaaatacaaaaattagctgggcatggtggtgggcacctgtaatgccagctactcggggggctgaggcaggagaatcacttgaacccgggaggtggaggttgtggtgagccaagattgcaccactgccctccagcctgggcaacagagctagactccatctcaaaaaaaaaaaaaaaaaaaaaaaaaagaataagaaagaaagaaagcacagagcagcccttactagacacaaattatgccagtgacttgatggcgtaattggacttcctgactccagaactgtgagaaacaaatttctgttctttatagatttcctaggctcagttattatgcttagcggcacaactgactaagatagaaattggtactgagaagtggcagtgttgcaataacaaatacctaaaaatgtagaggctgctttggaactgagtaatgggtagaggctggaagagtttggaagtgcatgctagaagaaggctagtttgccatgcattaaggcgattctgacgaggcttcagaagatgaaaagccatagagaaagcctccgtctttgagattatctaggtggttgtgaacagaatgttagaaagaatatggacagtaaaggacattctgatgaagtcttagatggaaatgagggatatcttattggaaactggaggaaaagccatccttgttacaaagtggcagaggatttgttcctggaaagaacagaacaaggtctgggaaagaagggagtttatttctgcagctggttacagggagaaggccggagtaactcaccataccaactcaaagttacaagtttttttctagtgcttatatacattttaagctcccatgctaggagtggaattgcacctccaagcaggagtgtttccttcaatctatatctaaactttaactaggacctagggtctggaaatctttctctagagtcttggaaagctttttaatctttttttctttttctttttttttgctgtccataagtttattgtctgtatctgaaaaatcatcatagaaaattgtttggtttagctctcagcagcctgcttctgagctctgaggaagcttgcattcttttgagctacccaatccttcttctgagcaagggacattttgggatggttccacctcttctttttaacttctttcttgggcttattttcatagactggattctctcgtatagcagcatgagcttccttatacatttcctccatcatgtctggagttaccctgttctttatgtattgagagaactgtttcttgtaagcattttcatcttcttccattaagtagcacatgtaatcggcaacattctggcccatgatgtgcttccggtgtacttctgcattaaattccttgctttcagaaccataaccagggaattgtttggtactgtgagggatagacaagcctccatccacagctcccttcagggcaccaaaaactttattgccagtggtagttctggcaaggcctgcatccaaatagcaggtaaaggcacttggctgaccatcaatgctttccacaatgtattcatcgccagtcacctccacttggccttcatagatcttgtccatgccaaacctactgagaagcctgcgggccagcggcaggccagtacaatatgctgcagcataatttgtcgggccaaccttcacaccatattttggcagttcgtgtgcatatgctgtgcagactatcatatccccctctatatgggcataagcaatctgacaaatgatatctctgtttgttacacgaactatcatcctgtatttgagtgtgttgtatttatttttatcctgtatcaccaagcgtttccgagtatcgtaatcagttttaccctctcatcatcgtcttctaaatttcacttggtatctcttaaagtaggccttattcttaacaactttaacaaaccccatcctgcagaacagagacccgcgtccacagctcaacagagaccagcaggcacagcggcgctggggcagggagaaggggaaagctttttaatcttcagtgggtacctggaacaaggtatctgtgtaaaatgcttttattattcaaccagactttaggctaagaaagcccattttaatgggtttattttaatattccagccctcatgctcagtcacctgtttctccagttctttaatgtttaacttatacattcattagaattataatagagggtcagtggaaactgactgttctggttgctaatgggagcctgccctgccacaaacttggtggaagtatttctgtgtcttaatagttttttggagggtagaatgtaagagcgatgaactaggacatttggcagaagaaatctctaagccaagttttcagggtactgcatagcttctcttaactgcttatagtaaactgtgagaagagaaaagataggacttctaatcaaaagggaagcagattagctgggcatggtggcacacacctgtagtcccagctactctgcaggctgaggtaggagggttgcttcagcacaggaggtcgaggcggcagtgagctatgatcgtaccacagtctgggcaacagagtgagatcccatctcaaaaaaaaatgctaattattattattattatcattgagatggagtcttgctctgtcgcccaggcaggagtgcaatggtgcgatctcggctcactgcaacctctgcctcctcccgggttcaagtgattctcctgactcagcctcctgagcagctgggattacaggcgcccgccaccacacccggctaatttttgtatttttagtagagatggggtttcatcatattggccaggctggtctcgaactcctgacttcgtgttccacccacctcagcctcccaaagtgctggaactacaggcgtgaggcacctcacctggccaaagactattattatcattattttatccaaaatgtgtttattgagatggtttcccactcatcttgattcagggtgcttttagtgctgctttctcctgaaggaccatccttccataagccttgcttttcctcctgtaggctggcagaggaaagtgcagcagccaacacccaaaaccactgttggcacatggctaaagaccgtggtgattttatagcatcctgggcatttcacatccatgaagtaggaattggggctctgcaccaggtgtttcttcttgtgtttcctcttctcctcttctggagagggatgaaggagatcctttgcaagaagcatgttcttgtgggtaggtcgtcagtgctggaaagggccaaagaaaattatttttaaagggaagttgaacataaagatttggaaaattaacagcctggccttgtaaagaattttttaaataagttcaggagacaaaaccaactgtgtggccaactgaccgtttcataaggagattagtatgactagaatgccagatgctattcattaagacaatgggagaatgaccctgaagacatttcagagagcactgagaatgccacaaccatcacaggcccaaagtgccaggtccttgagggaataacaattttaaggaaggagcccaggattccagtgcaacccaagatgcctgtgggaacttggggctcactgactatgctgcctcatgtatctgctccctgaagtcaagcaaagcttccccatctgtggttcaggtgggcccaggtacagctcagatcactcctccagaaaacacaagtagtaaaacatggggcagcatgcatgtggtgctaactgcaggcatgctaaatccacagctgtgaaggcatggctttctccacctaatttccaaggaagccttgaagaatgcctcagggcccaatcagagaactgctgtaggggcagggctgccatagaaagttcccactagggcaatgtccagcagaactattgggttggggccaccacagagtgccctcactagggcaatactcagtggagccatagggacagggccacccctgagttcctagacccagacctgtagatccggtagtgcgtattccaacctgtaatagacatagacacctgactacaacctgtagaactgtggcatgggctgactccagcagtcatggcagcagggtcccctgggggcttgggaacctaagcactaccccagtgtctctgtaaggtgagaggtagaatcaaaaaagctgactctcacacctcaagattgaattttgttggccttgttgggttttgaagttatgtgggacatgttacccctatcttcttgcctatttcctccaccaaccttttgtttttgccatggggtcgagctatgtcacccaggctggtctcaaattcctgggctcaagagatcctcctgtctcagcctcctgaatagctaagactgcaggcaccatgcctggcttatttctgacttttataaagggaatgtttatcctgtgcctgtccaaccattgtattttggaaacacataatctgtttgacttcacaggttcacagctggagagccattgtctcgggattaattgtaccttgagcatcacctatatctgatttagatgatatttacatgcgactttcgacttacacttgaaagttgatgctggaatgagttaagacattttggagttactaagatggaatggacatattcttgtgggtgagaacgacatgaattctcatgtcatggcaagggtggagtgctatggtttgaataatggtgtcccttctaaaattagtgtggaaatttaatgcccaatgcaacagtattaagaggtttggcaattgcgtggtgactaagccatgagggctctgctctaatgcatgagattaacatctctataaaagtgtattaatttaaagggagtactttcttgcccttctgccccattcaccatgtgaggacatagtcatggctcctccacaggatgcagcaacaagacatcatcttggaaacagacagcagccccgtttagacctccttctgctgctttgatcttggacctctcatcctccagaaacacgacaaataagtttatgttctttataagttactcattatcaggtatttatttatttatttttttgagacagagtctcgctttgtcgcccaggctggagtacagtggtgtgatctcagctcactgcaacctccgcctcctgggttcaagtgattctcctgcctcagcctcctgagtagctgggattacaggcatgcactaccacacctggctaactttggtattttcagtagagacagggtttcaccatgtttgccagtctgatctcgaacccctgaccttaggtgatctggccccatctgcctcccaaagtgctgggattacagacgtgagccactgtgcgtggccaatatcaggtatttctaatagcagtacaacggactaagatactcaggaaaacagagccaggaggaaaaatattctatctcagggagttaaggaatcatgcccactcaagaaagagtataagggctgggcatagtggctcacgcctgtaatctcagcactttgggacgacaaggtgggcagatcacttgaggtcaggagtttgagaccagcctggccaacatggtgaaagaccacctctactaaaaatacaaaaattagccaggcgtggtggcacatgcctgtaatcccagctacttgacaggctaaggctggagaatcgcttaaacctggtgggaggcagaggctacagtgagccaagatcacgccactgcacttcagcctgggtgacatagtgagactccgtctcaaaaaaacaaaacaaaacaaaacaaaaaaaacaaagaaaaagagtgtaggggaaaaataacactcagtttattttttagtccaaacagacccctttaacaaaataaagattaacaagagaaaagcaaacaagtttattaatgtgtgtatttcatctacacatggaaaatacccagagaatgaatagttatcaaagaagtgctttgaattccagcatatatagcatcttcagcagagaaccgtacatttttagagaagtgaaaagataaagaaaaaggagattgtgtccgtaggggtgacaacttacggaaaggcaaataaattgcagataaattcagttactaagcatgttgctataaattcctttggtatcatttccaggctgaccagggtctaaagttttcttcagtggttagcctttgttctccctggtaaaagcgtgagtgtggagagtggggagggagagggtaccttttgtcttcgcaactctatatcttgcttttcggccagtaaaggaagaacaaaaaacttccctgcatctgcttcttcttaattgtcttcagctcaacaatgcttccagttttagggtggcatattctggcctcccacaagagccaggaagaacagatgtgcagcccaacggtgaggaaataattttcaccctacaaagagccaggaaaaagaccttccattccaggaagtacctttcaaaagatacctgggagtctaatccagcttcaaactatactctgaattcttaagaatcaaggccaggtgtggtggcttatgcctgtaatcccagcattttgggaggctgaggcaaggggatcgatcacttgagcccagggtttgagaccagtctgggcaacatagcgggatagtgagatcctctccacacacaaaaattaaaaataaaaataaataaaaaaaattaaaacctatccttacaagcttcagtggacacttgtccagagcaatcaatggctccagagtctaattcaccagtggatccccaatcaacttattaggaataaagacaaggtttcaaaggtgcaccctgaggtcctgggtgagaggtccaggggaccaaaaatgaataactgaaaaaattatatattcagtgatacttattaaagcatggtaaagaaaactttattcaggaccattgtgatagatacagggaccaatgcaatgggattttgcaatggaatagagagattgctctgaactccaaatagatcatgggaaaaagggacgttataaccaagaagcagggttggggtgtagtgggtgaaggaatggaaaattactaaaaggaaacatcagggataagggggattctggctaaactgacacctaacaagattcttgttaaagatgggccagagtggtcatgtatcacttggaagatggtggaagatgaacctgatcagatatcaagggtgatcagatatcaaggagaagagggttcttttttatatttatttatttatttatttttgagacagagtctcgctctgtcatccaggctggagtgtagtggcgtgatctcggctcactgtaacctccgcctcctgggttcaagtgattctcctgcctcagcctcctgagtagctgggattacaggcgtgcaccaccatacccggctaatttttgtatttttagtagagatagggtttcaccatgttggtcaggctggtctcaaactcctgacatcgtgatctgcccgcttcggccacccaaggtgctgggattatgggggtgagccaccttgcccggccgagaagagagttcttgataaacagacttccttgttaaaactagattttataatgaggtccacagatgggtggaggagaagcctgagtaaattttggttaagcagagaaactttgtcatccctcctgtatgcattatgctcccttttctccagtggagctctcttcaaccttgatgttattgtccaatcagtttgttttcccagtgttgatgttctgatttcatcctacaaaaatatagcataaacttgtatttgttgcattctacaacataagcctgacaatataacaaactgttcccaaagttataaattcctcgtctttttatttgtaatttgacttttaaaaatctatgtaattatagaagaatgttgctactataaaaattttaaggggtggcagggaataattccaaaattataaaactccttgtgacaaatttaggaatgatattcagctagttctatagttttttattccttgaataatcagcgatatacatctgattatatacacacattgtggtttttttttggccaggttgactttttttttttttttttttttgagatggagtctcactctgccacccaggctggagtgcaatggcacaatctcggctcactgtaacctctgcctcccggattcaagtgattctcctgcctcagcctcccattacaggcacccgccaccaagcctggctaacttttgtatttttagtagataatggggtttcactacgtgggccgggctagtcttgaactcctgacctcgtgatccacccacctcggcctcccaaagtgctgggattacaggcgtgagccaccgcgcccagccttggttgacttattcttttaaggagcaatgtgggttaatgtttcaaagtgaaaaaatttaaaaacttaggggaaagtggggggagagagagacaaagacagagacagaaagagagacagagtgagagatggagagagatcagataggtacataagcttagtgactcagcctgtagtcccagttacttaggaggctaaggcaggaggattgcttgagcccagaaactcaagttttcagtgagcagtgatctgcaacactgcactccagcccatgtgatagaaccagatcgtctctagaagaaaaaaaaagaagaaaaaaatacatatacatacatacattggtgtttgtttctacatatgcttcatagtatatgtgtacatggattataggtagatcatataatggtaacagtattaaattaggtgtcagcatttgttgaggaagtagtacgctcgtgtttgaaattttaattaagaattgtgtacggagttggttccttccggtgggtttgtgggtttgtggtctcactgacttcaagaatgaagccacaagccttctgaaccttcgtggtgagtgttacaactcttaaaggtggcacagacccaaggagtgagccgcagcaagatttattgtgaagatcgaaagaacaaaatttccacagcatagaagcagactgagcaggttgccactggtggctggggtggagtggccagcttttattccttatttgtccccacccatatcctgctgattggtccattttacagagtgctgactggtccattttacagggtgctgattggtccattttacaaacctctagctacagagcatcgattggtgcatttttacagagcactgattggtgcattttacaaacctgttgtaagacagaaaagttctccaaggccccacctgacctacgaagtccaggtggcttcatctctcagaatcagcttttaaaggccataaatttccaggtaagtaggaatagaagaaatgaacatttcctttgagatctatgatgtcatatttttttctccatcaacgatttagttccttctggatcaaatactttttaaatggatgtatgttttatagtagatgttatgttgtcttaattattttaaaactcctattcctggactctcctgaagaggagaatttagtaatttcgaagtattttttgaggctagggaagaaaaaccaagattactgcataaggtttcaggggatgttccatgcctgccacctggtgaaaatgagggagctttcctcctacctgccaccattacacctgcctgcaggtaataacgccatcatttcaacgcggcctggggtattctgggaaggtgacgtgtgggggcgcagtgaccgctagcaggggccaaacccgccctggtctgcgctgcagtgcgcagtgaggatgttggtgctgctcttcagggttttctttccgcagccacgggaagcccgtgttccatatttgtttttcatgttctctcgtttttatgttgtggatttagttttttaaaaaccataaatgttcctctacagtcttaacaatgtaccctgtaaaataagattttaaaagagccaacttccctattaatcttatacttttttcttttcgttctggctttaacaaatgtgacctaaagagagctcttgattttatgtagaacaatacaagaatagttttacattaatcttatggttagaaaaatcatttatgggcaaatttgttcccatgccttacttttaaaatattgtgttgtctttaattttcaaaatactttaaatatttttcagtaagtttgagggtagaatttattttaatgagactcctcttataaaaagtacgtatctgtatgtgcatatgtgtatactgaatttgctttgcttttgattctatcattctgtcacttttctatcaaaatatctctaatggacagaggccagagacaaggacttttacagcaaatttgccacagtaccacacattttatcttaaaagatggtatggattttgcataacatatatatgcaaacatatatatatataacataatatatatgtgtatatatatataacattatatatatgtgtatatatataacataatatatatgtgtatatatataacataatatatatgtgtatatataacataatatatatgtgtatatatataacataatatatatgtgtatatatataacataatatatatgtgtgtatatataacataatatatatatgtgtatatataacataatatatatgtgtgtatatataacataatatatatgtatatatataacataatatatatgtatatatataacataatatatatgtgtgtatatataacataatatatatgtgtgcatatatataacataatatatatgtgtgcatatatataacataatatatatgtgtgcatatatataacataatatatatgtgtgcatatatataacataatatatatgtgtgcatatatatataacataatatatatgtgtgcatatatatatataacaatatatatatgtgcgcatatatataatatatatatgcgcacatatatataacaatatatatatgtgcatatatatataacataatatatatatgtgcacatatatataacataatatatatatgcgcacatatatataacataatatatatgcgcgcatatatatataacataatatatatgtgcgcatatatatataacataatatatatgtgcgcatatatatataacataatatatatgtgcgcatatatatataacataatatatatgtgcgcatatatatataacatagccgtttggtttattttatgtgtgtgcgttaaaaagttattcaattgctgggcgtggtggctcacgcctgtaatcccagcactttgggaggccgaggcgggcggatcacgaggtcaggagattaagaccatcctggctaacacggtgaaaccccgtctctactaaaaatacacaaaaaattagccgggcgtcgtggcgggcacctgtagtcccagctactcgggaggctgaggcaggagaatggcgtgaacccgggaggcggagcttggagtgagccgagatagcgccactgcattccagcctgggcgacagagcgagactctgtctcaaaaaaaaaaaaaaaatattcaattatgcttgttaaagcaaggtaagggtcaccatggtgataggtacagggacctctgcagatagagattgggctaactccaaacagcgtaggcaagcggaaatttataaccaaagagcaggctgggaggtctgtgaatggaaaattaccaatgagaaacctcaaaggttagggggattctggctaaaccagcctaacaggatttttgctgaagacaggccagggtgatcaaacatcacttgggggatggtgcaggatgatgaacctggtaagatattaagggtgatcagatatcaaaggtaaggaagttcttgctaaagctggatttgacaaggaagtgcacagactggagaaggttcaggtgcctgactaatgtttgatcaagcaaagaatctttgtcagtgtacagaacgctatgtttttataaaatgttcctctgccccatttgtatctccccttttcatggaacacaaagcacgttttgcataacttctagatacatgtacttctattttgaatgacctgatatatcttttttctttacaattctcaacctcagcatatgtaagtggaactcagaaggcaacattccctgaacatactcttccaccagaatctcctctacagatttttgctgccccttttaccagtggctgaatctactttctcttatgtaagtagaaattttatatatctccagcctcttcctccttaccttccacttgcatgcacatcctgtctagtctgtgacctcctctgttataaatgcttgtaaacctttttttctgaatcagaaacgtgttgtgttgctcaagccgtgttcattttaattacgatttaactgcataatttaattatttccccattttttggatacagtgtttgcttttctccggttactttgttctagtatatccctctggcaagagcagtcatttccccacttgagtgtgcattagtatcacctgggggcttgttaaacacagcgtgcaagctccatcccagggtttctaattctcagggtttggtttgcggcagaagaatctgcatttcgaacaagtgccaggactggtctgaggaacacacgttgagagaggtgggattcgggttcactaacctgggttagagaaaattacagtaatgtgccaaatctgaggagggagcagagctgaagcccagtttcaatatgtgaatgagtgctttatacactcaaaccccctcaagggctggggagtaagggagaacgtgggcgggcagcgggcgtgtatagaggcataaactcaatcccagacctatggattcagaatcacatgttaacaattcttccagtgttttgtatgtttattatagtttgagaatgactggaccaaattgcctccaaaatcttaagtcccagcagtgaagcgaagctcagacatcatttgcatagctattgctttgtgtctgtgttttaggtcagctgctgttaaaggtttgtttcggagagttacccaggtgtagtacccttccaagtagataatgattgaaagagtatgtgctggaggtgtatgatattttccatccacttcagcccatttttctgatgggtcagtgacagtccatgatttgtctggtgtaatacaaattctggaagtggcatatatccaaggacagccataatattccacttggccaaggctcttctgacaggctcatgttcatgcaggatcagatctgacccagaatcaacagaactgaagctgcaaattcagctttgtgaaggcttcagatgtagccatggttaaagaagattgacattaagcaggtgagcagagtttgcttgaggttcacccagggaattcgtgaggatgcaggtgcgtttttttatggcctgaaaagcccagtttttgaggagttacagtccctctcagaaactgttcctgcagagtagccctggaaacatgtttgtctgcattcaagaaagatcttccttctgttcatataaaggaagccaaacttatttcccaggtaagggagtggaagcaactgtgatacggaatcctaaggcatgggggttagttgtaatccaggcaatatgtagggtcaggttctccaagtcctcctgtggttaaagggctccaccctaggaaagtgagccacccagggcttggtaaatgaccttatgatcagcccttggcctgttaacatgtcgtaactgaggcacaggactgggttcttggtttgaatttgctagtcagatggccattgcagaaagggaagagagcacagtccttcaggccaactcacttggcctattgaaactggcttttctgagcacagtctagtattgttgcgaattaaatacagcagaggatgtaagttaccagtattagtcactatcagttgagtacttattctgtatcagccactgttcctcttttccatttccacctgttatatgttagtgacgataaaaatgccatacagaccgggcacggtggctcacgcctgtaatcccagcactttgggaggccaaggcaagtggaccacctgaggtcaggagtttgagaccagcctggccaacatggtgaaacctccgtctctactaaaaaaaaaaaaaaaaaaaaaaaaaattagccgggcaccgtggcgggctcctgtaatcccagctactagggagactaaggcaggagaatcgcttgaacctgggaggcggaggttgcagtgagccaagatcgtgccattgcactctagcatgggcgacaaaagcaaaactccgtctcaaaaaagagaaaagaaaaagccatacaaaaaggctaagagccttgttcaacctcacacatgaaagtggcagggctggggtattaattcaggcattcacaatccagatcctctacacatttcactgacatgaaacccagaaatttcaggtctactaccttgaacccagaactatttttctcaaacttgttttcttgtgagctatatatagggaaaaattgcatacaatacagtactgctttacaaatatatcatctaatacccaagtcaagaaagacatgatcctgagctccctcaaaactcgtgggtatcccttctgaatcttgaccttttattctgactgagatgaatcctccatgctgctctttgtaattttattcctcgtgattacatacttaagctacaggaatacatcttacgtagttttgtttattcttaactgtatgtatttttttgtcttttccacttgatattgcattttctgtatttatccatgttgtgtgtaattccagcttcttaatttttattgatggtgttctctcattatatataatatatacagcatgtagcatgtatctttctcactgtgtatgtatacagagtgtatgcatatcactataggtatacagacatatcattatcctagtatttccatatctatgccacagtaggcagatccttttttttttttttttttttttttttgggaagacagagtctcgctctattgctcaagctggatggagtgcagtggcgcaatctcagctcactgcaacctccgccttctgcattgaagcgattctcctgcctcagacccccatgtaactgggactacaggcacctgccaccacacccagctaatttttgtatttttagcagagatggggttttaccatgttgtccaggctggtctcgaactcctgacctcgggtgatctgcctgcctcagcctcccaaagtgctgggattacaggtgtgagacaccatgcgcggctgcagatcccttctatacctgatgattgtttgggttgtgtctagtctgcagttatcaccaacactgcaatcgtaatcactgaagtatgtgtatcctgatttatataggtacacatctctcaaggatctgtaactggtagtggaattcatggatcttcaattcaaatgttgctcatggcagtgttaattataacaaccactttggtaaactacctgctattacctacaaaaccatgtgtaccttacacacgcaccatccattctactgtgtggagtaggccacggaaaagtacatgcacagttgatgaaaagacatgtatttaaatgtttatagcagcattatttgtaatagccaaaactggaaataaagcagagtgggtaagtaaatggtggtataggaattcaatggaattcaactataaataaaaaataatgaactgtatctacatgtaaaaaccttgatgaattttataaacacaaagttgagcaaaataatctaggcaaaaacatacttgtctgagcccatctctgtaacattcagaagtcagtatgacaagtcaggatggtggttacctgtgacaggagagaggctgttttgggaagggctcacttgggtcttctcagttgctggagttcactgtgataaatttaggatttgtttctttttagtgccgtgtatgtgtgtgtgtgtgtgtgtgtgtgtgtgtgtgtatataaacatttttttttttttttttttttttttgagatggagtctcactctgtcacccaggctggatgcctggctttttgtagtttagtagaaatgaggtttcagcatgtagctctggctgatctcaagctcctgaactcaggagtctttcctcctgtacaggagggaagacctttcctctactttctgagaattcaataattgagtccttgaaagaaattgacagtagtcagattaatgggagaaaaggtatacaaattagatatggacacagggacatcacatgaaagaaaagcgaatatcccagaacccagtgagattcagaagcttatgtaccctcttcttaggacagagggtataggtgattaggtaacttaggggagagtaaacagtttgggggaaagataaatggactgtcagaagaacaggtaacagccggtgacaaagtctgcgtgtgttatcaaggtctactctcctctcctgtgataggagccaatcttccctggttagtgagtttcctggggaggggattcatgacaattaagttccttttagataatctgtctttagataaggaagctcagagaaaacctctgcctgtatgagctgctccccacataacctcagttgaaagtaatcagcacaccaaagcatcatattttggggtggagatcctcccgcctcagtctctcaagtagctaggaccagaggcatgcaccatcatgcccggctactttttttttttttatttcttgcagagacagagtctcaccatgttgcctaggctggtctccaattcctgacctcaagtgatcctcctatctctgtctcccaaacagctgggattacaggcatgagttaccatgcccaggctaggggtggcatttcctgaactccttcagccctcttgggaaatgtgcaggcaggaagaaagaaaagaatacccttgtccacagccaggtcttgttgagcttatgcttggcagaatagaaccttacacccagccacgtgaaaactgggatgataaatgtctgcatgtctgacagaaggtttggcctctgattcagctgtggtgatttttccatctacttaactccaaattctattagctagtataaactctctattggactatgaacacagtaagtacacaatcatatgattattttatctattgacttaaatagaattgtgtatgaaggctgtactgaagttattcagggttgagtcaggaaaagctaaatttcaacctcttttaagaaaaatattgatgcctccaaatccatagtatatatgttgcttactagcttataaagggcccctggaagaaaggacatttccggtgttttatgtcaatcataggaaaataagctataagcttttttttaattctttgattctcaaaagtaggattgtggccaggcatggtggctcacacttgtacagcactttgggaggctgagatgggaagatcgctcaaggccaggagttcgagaccagcctgggtaacaaagcaagaccccatctctacaaaaagaaaaatgtatgattgcgtccccctaccactccccaacacttccctggctccacaccccagttcctctgctctcatttctgctgtgtcttactccatgaagctttcaaaactgcttttatagagtcctccttttcttttttataaatttattattgttgttgtttaattaaaagacaggatctcactctgttgtgcagttgtgcgatcactacagcctcaatctccaagcgatcctcccatctcagcctccccagtggctgggaccataggtgcataccaccatgcccagctaattttttttttttttgagacagagtctcgcactcttgcccaggctggagtgcagtggcgcgatctcggctcactgcaagctctgcctcccaggttcacgccattctctggcctcagcctcccgagtagcggtagcgcccgcaaccacacccggctaattttttgaatttttagtagaaatggagtttcactgtgttaggcaggatggtctcgatctcctgaccttgtgatccgcccgcctcggcctcccaaagtgctgggattacaggcctgagccaccgtgcccggcccactaatttttaaatctttttgtagagatgggatctaactatgttaaccaatctagtttcaaactcctggcatcaagcagtccttctgtccaaagtgctgagattgcaggcatgagccactgtgccaggcccctcattctttaaatagctactttagattctattgtaaggatattttaataattttccaacttttattatattgagtaggtgattcctttttaaattatatatgtaaatttttatttatatatttgaataatatgtttacatagttaaaaatcaaaatatacgaaaggcatacagtaagaagtcatctctttccacccgtaatgacaatatatccccttttgcctggcacagatgcacacataaattattgtcctgacatgattatgaataatcctgctttctctcagaagtgtgctagtttgaatgataaattatgcagacattctgcttgtatccctgcttcttcaccatgctgttatattccttccaattcagaggcaaatgtgatatcattgcctatgtgtcttccagaggaattttatttatattttgtaagtacatacatggattctggttttttttttgcactttttaacaaatagatgtatccatgctattttattttaaatttttactttgaaacaaccttaaacttacagaagttaaaagaatattagtagcaggtgtgctggctcacgggtataatcccagcaccgtgggaggctgagatgggtggattgcttgaggccaggagtttgagaccagcctgggtagcataatgagacctcctctctacagaaaaaaaaaatgtaaaagttagttgggtgtggtgttgcatgcctatcgtcccagccactcaggaggctgaggcaggaggatcgcttgggtacaggagttagaggctgcactagaccatgatcacaccactgcactccagcctgggtgacagagtgagaccctgttgcttaaaagaatattttaaaaaaaacctaccctttatccagattcacaaatactaatattttttcacattatttaatcaatttttctccttccctccctctttcatttctcccccttttctttttttttggagacatgatcttggtttgtcacccaggctggggtgcaatggcataatcatagctcaatggcatttcaaactcctgggttcaaagaaacctcctgcctgagcctccagaatagctgggactacagtcatatgctaccgtacctggctaatttttaaaattttttatagagacaggatcttgccatgttgcctaggctggtctcaaactcctaggctcaagtgatcctcccaccttgacatcccaaagtgttttgattacaggcatgagccaccaagcctggcctcctttccctcttttttttctccctctgtttcccactgcttataaagtttttaaattttttttttttttttttttttttttttttttttttttttttacttttgaccactttgagagaaggttgcagacatcatgtccctaatgcatttcctgagaaccgggatatacgtttggataatcatagtaaagatattaattcaggaaatataacatttatacaattattttatctaatctacaggccataacccagtttcttcatttgccccaataatgttttttatagctttttcatgttaaatatcttgtttggcactaagtatcttatcagtctgccataatgtttaatatctttcctctgaaatggttcctctgcctgcctttgcctttcatgtgtttgtgacttttgaagcatgcatgctaggtatgttacggaatgtcctcagcttgagtccatctgaagtgttcttaagactggattctactgatgctgttttggttggcacaacacggtgtttactattgtggtcgtcaaaatgatgttttatggctaaaccattctttcaacatttaatcatcaaggaaatataaatcaaaaccacaatgagatatcatctcatcccagttagaatttgctgttatcacaaagacataaaaataaatgctgatgaggatgcagatgacagggaactctcctatacttttggtgggaatgtgaattagtatagtcattatggaaaacagtatgcagagtcctcaaaaaactacaaatggaactaccctgtgaaccagcaattccactactgagtatttatccaaagttaaatcagtgtattgaagagagagctgcactcttgtgttcattgcagcattattcacgatagccaagatatggaatccaccgaagtgttcatcaacagacaaatggattaaaaaaatgtggtgcatatacacaatggaatactatttagccataaaaaaagaatgagatctggacattcacagcagcatggatggaactggaggacattatgttaaatgaaataagccaggcacagaaatataaatagcttaaaaagttgacctcatagaagtagagagtagaattgtgattaataatcacaattataaataatggtcagtatcaaaaaaaattgtcattctacagtgctgcagaacattagaacttgttttctctatctagctgtaattttccctcttttattttttttgaaacagggtcttgccctgtcacccaggcatggcataagcacggctcactgcagctcaaacaatcctcctgcctcagcttctggagtagctacaggcacatgccatcatgcctagctatttttttttaattttctataaaggtggggtcttgccatgttgcccaggctagtctcaaactcctggcctaaaacaatcttcctgccgtggtctcccaaagtgctaggattacaggtgtgagccatcactcccagctccaatttttagatactgaccccatttagatacatgacctcagaacacattccaagctcatgttgtatctctcttgtccccactattaaatcagctgtgttttttccaaggaatcctgatttctattgtggagaagcgtacttagaaaccaaggtcttggtgctactggtatgttattgcttttaggcccttccagatatacgggatataaagatatagctatatgtatgtgactatatgtattgtgtatatatgtatgtagctatatgtgtgtatgtgtatatatatcttcatgtatttatagtgatattttccatcccaatctacaccgcagggtttttccttgccttcctatttgtagagcttccttccacattaagaaccctctctcccagtgagtgtcaccccatttctgtttcatctctttccctactctcccccttgcctcctagggtcccctttcctctcatcagttgccagacaagaggagcatcatcatacacacatcatagatttaatattaaacttttaaaattttcagataaatgtaagcaggcttctgcagtgaaaggggccaggtctaggaagatggggaatacttgcaggcacctgggaagctcagggaagctgcaggtaccctgtcagttgggtgtcccctcatgagggtggcagactgtctccttgagttctgggtggcagaaatggcccagggccctgggctgagacccagccaactctctatggggctgccacacgacttcctaaaaaggcataaacacattttcttccaagtggagtccagcatattttattttcctgttgaatggtagacagcatgagagcagggtccatgtgatgatttttctgtcagtatcagtttctgcaagagcaaaaattacatatttttatttttcaaataaaatcaattgagacagtaacaaatttgctcaaagaatcaacctgaacacatgtacatctattatgtatcaataaaaaaatggccaggcacggtggctcacacctataatcccagcactttgggaggccaaggcgggtggatcacgaggtcaggagatcaagaccctcctggctaacgcggtgaaaccctgtctccaccaaaaatacaaaaaattctctgggcgtggtggcaggtgcctgtagtgacagggcgagcttgcagtgagccgagattgtgccactgcactccagcctgggtgacagagcgagactccatctcaaaaataaataaataaaaataataaatttttttctagataaaaaatataaaaattacaccacagtccaaaaaaaaaaaaaaaaaaactgttcaagactgatctttcatagtgattgggtctatgagtaaatgttaaatagatgatttattaggtttctttttatttcaatgatgagatggagaaatatattattttacatgagggcaaaaaatattttatgcatagatattttttattttgcctatgtccttaaattctcagaatatagattattgccttcagaaatctgtctaggttcacctataccttattagaactcagctttgctggctgtggtacacctgtaatcccagcactttgggagactgagaagggaggatcacctgagctcaggaatttgagaccggcctgggaaacatagggaaaccctgtctctacaaaaatacaaaaaaaaaaaaaaaaaaagtctgggtgcagtggctcacgcctgtaatcccagtaaatcccagtactttgggaggccgggccgggtggatcccgaggtcaggagttcaagaccagactggccaacatggtgaaaccccgtctctactaaaaataaaaaattagcagggcatggtggtgagcatctgtaagcccagctactcgggaggctgaggcaggagaattgcttgaacctgggaggtggaggttgcagcgagccaagattgtgccactgtactccagcttgggcgacaaagcaagagtctgtctcagaaaaaaaaaaaaaaaattagccaggcatggtggtgcacacctgtagtcccagctactcaagaggctgaggtggggagccctagtgggtgcagtgagccaagatcacaccactgcactccagcctgggcgacagagtgagactctgtctcaaaaaacaaaaaagtgagctttaataaattctataaaacttttttctagttgagagtacgttactacaagctaacttttaaaaaagtcatattatttgattactaggaactttgcaattagttttgcttcttctggtttttatttttgcctggcacaacatttccttccttggcccctgtctgtattaataatgctgccaggatatactgaatgattttattccagttttttctaccttaattatgttaaagaaaaacaaaagctgggtattagttatagtggtaaggacacattttaatcactaataactattgtaatcgtgaagaaagtccagcatgaactgaactcaactttggtgtgtacagaggtgactgggtattttaaaggaagaatgaagctgggtgtctactggacactggaatgaagctactgcagaggctgaggcagaaggattgcttgagccaggggtttgagaccagcctgggcaatacatcaagacctaggctgggcggggtgccacacgcttgtaatcctacactttgggaggtggaggggcggggggtgaatggcttgagttctggagttcgagaccagcctgggcaacatcgtgaaacactgtctctacaaaaatacaaaaattagcagggaatggtggcacatggctgtagtcccagctactcagggggctgaggtgggagaatcccttgaacttgaggagacagaggttgcagtgagccaagatctcaccactttactgtagcctgggtgacagagtgagaacctgtctcaaaaaaaaaaaaaaaaaaaaaaaaaaaaaagactttgcttcacccacaaagggaaaatcagggaataggagggagttgagttgtggggtagggtatgctcagttgagtcagagaagtaaaaatttaccaaaagtggtggttccatgtaaaacctacctgggattgctaactggtgctgtttgaagttagactatgaccctcgcacagaggccaggagacaggggccctatcttctgctgttggctggaacaaagagtaaattcatttgggaggcttcacttttttcaggcaggctatttaagggggatacagtcaaccaggggatatggccttgagatgctagaatctatgttagtattttgttcaaatatttataggccagggttaagactgactttgtttctttgttttttgagatggagttttgctcttgttgcccaggctgaagtgcaatggtgcgatcttggctcactgcaccctccgcctcctgggttcaagtgattctcctgcctcagcctcccgaggagctggcattacaggtgctcgccaccacgactggccaatttttgtactttagtagaaacggggtttcaccatgatgtccaggctggtcttgaactcctgacctcaggtgatccgcctgcctcagcctcctgaagtgctgggattccaggcatgagccactgtgcccagcgtaagacctagttgagaaggcagctcagaggaacctggctagagtttggtcaagaagactatctctgtcaatcataatgtgtattccaccaataagagtcattgagtctgtaaatgtttttttttttttcctttgagacagagtttcactcttgttgcccaggctggagtgcaatgacacaatctcggctcactgcaaccttggcctctcaggttcaagtggttctcttgcctcagcctccaaagtagctgggattacaggcatgtgccgccacacccagctaattttgtatttttagtagagatggggtttcacgatgttggttaggctggtctggaactcctgacctcaggtgacccacctgccgcagcctcccaaagtgctgggattacaggcgtgagcccccatgcctggccaagtctgtaatcttgattgaaagtttacttttgactgggcatggagctcatgcatgtaatcccagcgctttgggaggctggggcaggaggattacttgagtccaggagtttgagaccagcctgggcaacacagggagacctcttctctacaaaaaataaaattagccgggcttggaggtgcgtgctgatagtcctagctacttgacagactgaagtgtgaggatcacttgagcctgggaagttgaggctgcagttagccaagatccatgccactgtgctctagcctgggcgacagaatgagaccctgtctcaaaaaaacaaaaagaaaagaaaagttgactttttgccagctgttaggaaaacatctgtggctctggagggcggctggtttaaagaaaaaaaaaaacaatcagacatacctgatatctacaagaggataatgagcttagtatggtgtgtgtaggagcctagaggagagaggctgggaggggattcttggggaaaacggtggttgagttggggttcagaggcaagcccctaggtcttaggctgggcacggtggctcatgcctgtaatcccagcacttcaggatgctgaggtgggcggatcacctgaggtcaggagttcgagaccaggctggacatcatgatgaaaccctgtttctactaaaaatagaggagaatttgatggccattcacagtcaagggaactgaacacatcaaagggattgccagaagggcagaagtcctgacttacaggtataaggagaaacagaagaggagacaaggtgtggggtctaccaggtgggcaggcccattgagtagagggtacatggcattcattgaaggattttcatcaaggcagtcttctggtaagatacggggaagtccacaggctaattggaaaacagaaagaatgagatcatggagacaaatttagggactgactccgtctgtattaatttataccaggggtcagccaagtgcaacctgtggctaaatttggactgctatgcatacatgtatggcttgtgagctaacaaagttttttatggttttaaatacttgagccaggtgcggtggctcacacctgtaatcccatcactttgggaggccgaggcgggcgaatcacctgagtttgggagttcgagaccagcctggccaacatggtgaaaccccgtctctattaaaaatacaaaaattagctgggtgtggtggtgcatgcctgtagtcccagctactcaggaggctgaggcaggagaatcatttgaacctgggaggcggaggttgcagtgagccgagatcatgccattgcactctagcctgggcaacagagtgagactctgtctcaaaaaataaaataaataaatacttgaaaaaagcaaaagaatagcatttaataaaaattatataagattcaaatttcacggtccataagtgaagttttattggaatacactcatgcccacttgtttacatattgtctgtgactgctttcacacttcacactacaaaggttgagtagttgtgagtgatcgtcctcaaagcctaaaatatttactctctggctctcctctctacagaaaaaggctgctgatctctgcctgattcattgattgattattatttgaaatggggtttcactctgtcatccaggctataaagcagtggcgtcatctcagctcactgcaacctccacccgccgggctcaagcaatcctatctcagccttctgagtagctggaagcagaggcgtgtgcctccgctcccagctaatcttttgtatttttggtagagacggggtttcaccatatttcccaggctggtcttaaactcctgagctcaagtgatctgcctgcctcagcctcccaaagtgctgggattataggcatgagccaccgtgcttggctgacctctgatttatatggccagatgggggcaggtactcagttgcttgtgcatattttgttgggagatcacaagttagcaagataaaagtgctttcatcacagaggtttcagtctagtagaagttaaatttttgtgccgggttcagtggctcacacctgtaatcacagcactttgggaggccgttgcaggccggttgcctgacctcaggagttcgagaccagcctgggcaacacagtcaaaccccatctctactaaaatacaaaaatctagctgggcatggcagcatgcccgtatagtcccagctactcgtgaggctgaggcaggagaattgcctgaacccgggaggttgaggttgcagtgagccgagatcatgccgctacactccagcatgggcaacagagcgagactttgtctccaaaaaaaaaaaagttcgatttttgtttaataggtgagatcatatgaaacataaatataagtactgatgtagggattgtgctttgtgaatgggtctctgcctgcaaaacattcctgagaagctttctgaagggttcaagctgagaacagaaggatggagaaagagattctgtaagttaggaggcaagaatctgagctaagatttggatgtgacaggaccatgagtggatagggaatgttttgtttcttgagtgggaagtgggaagcattttgggaacaaggtaaggaagagagaggaggctgcagtgtttttaaggagtcctgcccacgccaagaagtctggactggaggtcatttgctttaaacatgtcatctcaagcatgtgtgatctatttggagcaaatataatcaagggaagttttaaacaggagagttttcagagcagtggagtctgaaaagttgccctaaaataaggttgagcataagaaagtccttcttgcttctggaaaaagtggactatgggtgctcactctttggggccagacagagaagaattaaaaatcatgggctgggtgcggtggctcacccctgtaatcccagtactttgggaggccaaggtgggtggatcacgaggtcagttcaagaccagcctggccaacatagtgaaaaccacgtctctactaaaaatacaaaaattagctgggcatggtagcgcatgcctgaagtcccagctacttgagaggctgaggcaggagaatcacttgaacccaggaggcggaggttgtggtaagccgagatcatgccactgcactcccgcctgggcaacagagcaagactctgtctcaaaaaaaaaaaaaaattgtgttatttctcccttttgcacctaatctcccactgaagatgactgcaactttcctgtgaattctgaacctgctgccaaaagatacttctttatattccatgattttgtgtaaaactttgtggtgagaattagagaaagcttaatttgctgcttggcatccagaattaggaggccaagttaggctcccatgttaattttcagaaagcccatgttcctgatatctggtagggatggcggtgctgaactgtgaaggtgttggaaaccagaattttggcagaaacggagtcagatttgaacatggtacaaatttggaccaagggcctagtgatagttaggtcaggaaattggggactgtattggtccattcctgcactgctataaagaactacccgagcctgggtaatttataaagaaaagaggtttaattggctaatggttctgaaggctctaaaggaatcatggctggggagtccctaagaaacttgcatcatggcagaaggcagaggggagtcaggcacatctttacatggcagaagcaggagagagagagcaaggggaggaggttccacacactttcagacaaccagatcttgtgatatatcacaagaagagcaccaaaggggaaatccacccctgtgatctagtcacatcccaccaggccccacgtccaacattggggattacaatttgacatgaaatttggatgggggcacagactcaaaccacatcagggaccaaagaaatattttacttattttcagttatcaatggaatttactgctgatgagaaataaatgtatcttgccagtaacttataaagtaataaaaccggccaggtgcgatggctcacgtgtgtaatcccagcactttgggaggctgaggtaggtggatcatgaggtcaggagatcgagacaatcctggccaacgtggtgaaactctctctactaaacatacaaaaattagctgggcatggtggtgcgtgcctctaattccagctacttgggaggctgaggcaggagaatcacttgaaccagggagccggagattgcagcaagacgagatcatgccacaccactccagcctggcgacagagcgagactccgtctaaaacaaacaaacaaacaaaaaaatcaaaacaatttccctagaaatgtataattattgacactttttagtatttaaaaaattttcagtgataccctgtatttacaaaacaaaacaaaacaaaaaaaacgaaaaagcaagacaaaaacaaaacaggcatggtgatgtgcacctgtagtcccagctactcaggaggctgaggtgggaggactgcttgagcctaagagttcaagccatgatctcaccactgtactctagcctggatgacagagcaagactgtctctaaaaatttttttaattaaaaaaaaatttcatcttgacttgcttttcatgtgaatctagtgtatttgctactttttgataatgctttgcactttttaaattgtaaaaacattacataaaattttcatcttacccgtttcaggggcactaagtgcattcacattgatgtgcaaccatcaccactgtctagctctagaactttttgtcttacaaaactgaaaattgcccattaaataataactccgtttcctcctccccacaccccatcccctggcaaccaccattctacttcctgtctccatgacatttgattagtctggatatctcgtataaatggaatcatacagtatttgtccttttgtgacaggcttatttcattctgtgtagtgtttccaaaattcatccatgttgtagcatgcatcagaatgtacttcctttttgaggttgaatgatactccattgcatgtatgcattacattttatttattaatccatcagtggatgtttaggttgcttctgccttttgggtaatgcaaataatgctgctatgaacatgggtgtgcagatacctctttgagtttctgcttctaattcgttttttttttttttgagctggagccttgctctttcgcccaggctggagtccagtgccacgccatgatctcggctcactgcaacctccacctcccaggttcaagcgattttcgcttgattctcctgcctcagcctctcaagtagctggaattacaggctcaaaccaacacaccaggcgaactttttatatttttggtagattgggggtttcaccatgttggccaggcaggtctcaaactcttgaactcaagtgatccacccaccttggcctcccaaagtgctggtattacaggtgtgagccaccatgcctggccttctgcttctaattcttttagatataaccttgaagtgacagtgctaaatctagcactgtctggtcttgaactcctgacctcaagtgatctgcctgccttggcctccgaaagtgctgggattacatgtgtgagccaccatgcctggccaattgaagatttttattacttacattttcccagaaagggggcatgccacactacaccacatcacgtgaggagcactaggttttggtcaggaggcagaagataggagtgaagggaaaaatctagggcaaagcctttactggggactccaagggaaacacagggcaggtttgagcataggatgggttagtttaaataattctggttggctttgggctacagggatggtctctagtgacttggtttgtgccctgggtatatagaatatgggaaatagtggccagcgagagttagctaaggagttggctgggctacagactgggattggttgtttggcatatgaaagacatgcttatagacaaattgttattatattcgagaattagctagctttgggaaggacattctctcccatgatttgcaaggccctcaaaagccagagcaacaaaaatacagaaaataagatatagttaatataattggcttggtgatgaacggatcccaaatagtcaaacacagaagctaagaaaacccagaacacatggtaattcttctgttgcattttttttaggaaaccacatagtgttttgcatagtggctgtaaaaattttccattcctaccaacattatacaaggttttcaattcctctggtcttcaccatgacttacgttctgtttcttctgtgttttatagtagccatccaaatgggtgtgaagtggtatctcactgtgattttgattttgattttgatttccctgatgattagtgatgctgagcatctttggatgtgcttcttggccatttgtatgtctttggagaattcttattaagacgtttgcccatttttatgtatgtatatatgtatgtatttatttattgagatggagtctctttctgttgcccaggctggtgtgcaatggcccaatctcggctcactgcaacctccgtctcctgggatcaagcaattctcctgcctcaacctcatgagtagctgagattacagatgtgcaccaccatgcctggtcaatttttgtatctttagtagagacggggtttcaccgtgttaaccacgctggtctcgaactcctgacttcgaatgatccacccacctcggcctcccaaagtactgggattacaggcgtgagccgctgcacctggcttggcccattttaaaatcaggttttttttttttttaaagttgattatagaattcttctttttttttttttctttttgatacagagtctcactctatcgctcaggctggagtacaatggtgtgatcttggctcactgcaacctccaccttccgggttcaagcaattctcttgcttcagcctcacaagtaactgggattacagacgtgtaccaccatgcccagctaatttttgtatttttattagagatgtgatttcaccatgttggccaggctggtctcaaaccattggcctcctgtgattcactcaccttggcctccccaaatgctaggcttacaggcatgagccactgtgcctggctgaggagtcttatatctattcggactattaacatcttatcaaatatatgatttgcaaatattttctcccattctgtgtgttgccttttcactctgttgattgtgtcctttgatgcacagaaggttttgattttgatatactccagtttatctatttttgtgtttccttagcttttggtgttgtagtcaagaaatcattgccaaatgcaatgttatgaagcgttttttcctgacagttttatagctttaggtcttatatttaggtctctgatccatttcaagttcatttttgtatatgatgtaaggaaagggtccaacttcattcttttgcatgtggatatccagttttcccagtaccacgtgttgaaaaggctgtcctttccccattgaaggtcttggcacaattgttgaaaatcatttgaccatatggaagagtttatttctgggatctctattctattccagttgtctatgttttgcattctttttaaaaaatatttttagtctttacatttcagaatcagtatttcaaatgtgacttgtaggactacgtgcagtgaggaagattgttaatcatcctattctgaccaggagttctgacaactttggtgctgtaggcggtgtctaaggcaggtgtcagcaaattttcctctaaaggagctgtgtgtgtgtgtgtgtgtttgtgtgtgtgagtgaaaaagaggtgagatttattttaaatttattttaagaaattggcttacatgatggtacagtcttgcaagtcaaaaatctgcagactaggctggcagtctggagacccagggaagagttgcggtgttaagtgttaagtctgaaactagtctgaaggcagaattccctctcttcctcaagagatcttaatctgttttcttttgtttttgtttttgttttgagacagagtctcacagcccaggctggagtgcagtggcacaatcttggctcgctgcaaccttcgcctcccaggttcaagcgactctcctacctcagcctcctgagtagctgagaccacaggtgcacactaccatgcctggctaatttttgtatttttagtagatacggggttttaacatgttggctaggctggtcttgaactcctgagctcaggtgatccatctgccttggcctcccaaagtgctgggattataggcgtgagccactgcacccggcctaacaatgacattttatatacacacaggcacatacacaaacctatttataaaagatgaaatactcaagacaattacagttctgatttctgtaactggtcaggtggtcacagctcatatttgtaattacctttgtctactactcattatgtatttccattgtcctcagcaagcaccacggctggttgtgattatttatctggtggggtgacccaaacctttgatttctgaagggtctaggccagtcatagtcctgcctgaatttcgttgttagagttttccatgggctttggtcacagagcttggttaatcctgaaataccctaagggatcccttgtacttcatatgtattcttccttacttcctttgtgaagcagaagtccagtttctccttggtaatcaggatgagtggcactagccagcacaacaattcccttctttgttgattcaaaggcatgaggagcctaaaagggttagatggcagttttttgtttttatttatttatttatttatttattttttagacagagtctcactctgtcacccaggctgcagtgcagtggcgcaatctcagctcactgcaacctctgctgcccggggttcaaacaattcttctgcctcagcctccccagtagttgggattacaggtgcctgccactgtgcccagctaatttttgtattttcagtagagatggggtttcaccatcttggccaggctggtcttgaactcctgacctcgtgatccacccaccttggcctcccaaagtgctgggattacaggcatgagccaccgtgcccggcctagatggcagtcctaacttctacttcagtccaattactgctatatctactgatggaaatattcctgctgttggaactaagactgccagaccagaagagtatgagatcatggggacaggaaacacaaattttgctagttggtcaactagggatatttgtggagggctgccactcccatttctatcttttggtttctagacttgtcaaccccgactatgggagaaacagcaatatattggacactgactcagacagtatacagcctcctgaaaagccttaccccagtcctgtaaagtattaccaaatagctggtactgtaactgaatcttcaaaaggcctttccaccattctatgaaatcatctgccttaggatggcggggaacatggtaagaccaccaaattccatgagcatgggcccattgctgcatttcctttgctatgaagtgagttccttggtcagaagcgatgttgtttggaatactatgatagtggttaaggcattttgtgattttacagagggaacttttgacagaagcattgcatgcagtgtaagcaaatctgtatccagagtaagcatctgttctagtcaggacaaaacactggcccttccatgatggaggggattcagtgtaatcaacctgccaccaggtagctacctgatcactgtggggaatggtaccatagtggagactcagtgttggtctctgctgagggtagattgggcactcagtggtggccatagttaggttggtcttggtgaatgggagttcatgtggccaaacccatgcgtaaccttcatccctgccatcatggccacttcgtttataatcccattgggcaatgacagaaaaatgagcctgactgtacatatgaaacaggtcaccctatccactttgtcataaaaatcctcctctgctgagtgggcattcacatggccacaaatgtctttacctttttttttttttggggctgatttagaggggtctatctataagtccatctatctcttcccaaggcttccttgtcaccaattttccaatcatgctccttccacattactgaccagccaaaccattgaccacggcctataaattggtatataattgtatatctggccatatgtccttccaaacaaaataaacaaccaggaacactgtcccaagctttacccactgggaggatttgtcttcaccactcttcttcagggaggtcttcagaaaggctctgtagtgcagcagttgtccacttctgggtggtatgtgcatgttttgtagaaccatctgtaaaccaggcctgagtcttctctttttccatcatctgattgaagggaaccccccatgagccataggtgcagctgggatagagaaagcagtgtagcaggagtgggggccgtggacatttgagccacttcttcatgtgacttagttgtgtcttcagatcatgttctggctgtgtaggcttaactttacagctgggctggtaagataacacccagttcatgaagggcagcttaggttacatggtaacttggtgtcctatggttaagcctttagtctccactaatgcccagtagcaggccaacagctgtttctcaaaaggagggtagttaactacagaggatagcagggctttgctccaatatcctaaaggcctatgctgcaacttaccaatgggggcctgcaaaaagctccaaaagacattactgtctgctactgacacttcaagcattattggttcttttttttttaatttttttatttttcgagacagggtctcgccctgtttcccaggctggagtgcagtggcatgatcctggctcactgcagccgctgtctcccaggttcaagcaattctcatgcctcagcctcctgagtagctgggattacaggggtgcactaccatactcagctaatttttgtatttttagtagagacggggtttcaccacgttgactaggctggtcttgaactcctgacctcaagtgatctatctgcctcagcctcccagagtgctgggattacaggcatgagccaccacacctggctgcatcattggttcttgcagaatcatgtgaccatagaggcagagaaatttatgttgcagcctggacctgttgcagaagcttctgttgttttgggatccactcaaaactacagcttttcaggtcattaatgtagcacatgagctgggtgtttgaatccctgagctaattttccccctactttgttcagtgaaattaggtgcaactagacagtctcattatacttgttagtttgacaaaatgtttgaaggtatcatacatgttaacccagaaccttgccttttatacttatttaatttaaagtatctgggctgggcgttgtgggatcccagcactttgggaggccaaggtgggtggatcacctgaggtcaggagttcgagagtggcctggccaacatggtgaaatcccatctgtactaaaaatacaaaaagcaattagctagtgttcttttgattactcgtaattaatgcctttaaatctagttagtttagagtaccaatttcagaaaccaaccccagaactaattcagaaaatttattcttaagatctggttcaggtagagctactcttgctaccgaaatctgtgtgtgttagggttctccagaaaaacaaaatgaactaacaggatgtgtatagtctcagtctctgtttctctttctcagaattggtcatgtggttatggaggctggctagtccaaaatcttcagagcaggctatggattcagggaagagttgatgttgtagctctagaccaagggcagtctggagagaatttcatcttctttttctttggtttgttttctcttatgggtttcaattgaatggatgaggtccacccatattaaagaaggtatctgctttactcaaagtctactgatttaaatgttaatcccatctcaaaacatgccatcgtggcaccatccaggttaatgtttgaccaaatatctgggtaccatggcctagccccattgacacataagatcactatcacagtcagataacaaatgtttagctttgtgggtcatatggtttatgttacaactactcaactgtgtggttgtagtcatagacaatacataaacaaatggctgtggctgtgttccaagaacactttatttatagatactaaaatttgaacttcatataatgttcacatcataaaataaacttttccttggatcctttcctcctttcctcctctccccctttcccccacccaccatgtaaaaaaaaaaaaaaaaaaaaaaagtaccacagccagttgcaatggtaggtacctgtgcatatcactatgcctgtaatcccacctacttgagaggctgaggcaggaggatcacttgagcccaggactgcaaggttatattgtgctataattaaacctgtgatcgtgccactgcactccagcctgtgcaatatagaaaggccccatctctttaaaaaaaaaatatacaggcagcaggcaggatttggcatagtttgctgaccgtcaagggctctcttttctaaaacataggcatggtaagaatatgtgcaaaggccatgggtgaagagctttttattttgttgcttgtgttccagttggtgcattctcaagagtaggtactttcttttcttgttcattctcttcctgagcctatcttgggattttctaagaaggttgctattagtctagtctttttccagctgctccctagattgaggcgggagaggagaaattcagcaaagatttctctctcctcatcaaggctgtcccttgcctgctttcctgtgggacagatggtgcatgtaggcaaaaggctggaacatgttggctgctcctgttacttggtgctttgagcagaaaggcctgttgggttagttcctgggctccagtgctcaatgtgtgtgtgtcctgttttgtgtttttacccatctttctgccttggctttaggtttatatgtttgcatttataaaaacttcttatggaatagaattataatgaagaggagcagcaaagagttgtggttgagagctggcagtactggaatcagaatgcttggcttgaatctgggctcaaatgcttgagagctgtgtgactttgagtacggttcttttcttttctgggcatcagtttcctaatctgtaaaagggatggaaatagggccaggcatggttccttatgcctgtaatcccaggtactcagaaggctgaggtgggaggatagcttcagcctaggaggtcgaggctgcagtgacccatgattgtgccactgcactctagcctgggtaacagagtgagaccctgtctctaaaaaaaataaaaagaaaagatggaaatgaaatagtaactcacacggtttttttgttttgttttgtttttttgagacgaagtcttggaatctcactctatcacccagactagagtgcagtgatgtaatcatggctcgttgtagccttgacttcctgtgctcaagcaattttcctgtcccaacttcctgagtggctggagctacaggcacgtgctaccatgcccagctaatttttgtatttttagtagagatggggtctccctatgttatgcaggctagtctctaactccaaggctcaggtgatccctctgctcagcctcccaaaatattgggattataggcatgagcctgcagtggccatcacatggtttttattttttgttttttatttatttttaattttttatggatctagtcctgaatccagaacatgatttttaaatgaactaatgttaaagtacttagaaaagtatctgctgcatagtaaggatatgtggttgtacaataaataaaaataaagagagctgctcacatagagtgcagatttcaaaccatctagtctttctcgttttattacattgaatttctgcttctgaatttttaattttgttataagaaggatgttagtccctctaaagtatcatttccaatattttgtttatgttccataaattttaaggttattttacttcaaattattttataatgtatatgccttttatatttgttttagttatatcaaaatgcagctttcaaaaatattttagtgtgtataattatttcagattactattagtagaagtgcttttttaaaagacaaatattatatttaagagaccctgccacaaaagtactcctcatggaagggaagatggactggggatgatgtggcagttatacagggaaaacttcacattattttgtatttaaaacataacctgaggctgggtgcggtggctcacgcctgtaatcccagcactttgggaggcagaggcaagtggatcacgaggtcaggagttcaagaccagcctgcccactatggtgaatccccgtctctactaaaaatacaaaaattagctgggcatggtgacatgcacctgtagtcccagctgcttgggaggctgaggtagagaattgcctgaacccgggaggcggaggttgcagtgagctgagatcgtgctattgcactccagcctgggcaacagagtgagactctgtctcaaaaagaaaaaaaccaaaacagaaaaacataacctaattttatattttgttttgtcatacagttgtatttgttttaaaatatctttccaccccttccaaaagtattttatccaagtagcagcacatcttatttccatgtctgggttggactttatttatacttgtctgaaactaaggaaaaagaaagtaatttatatcagttaaaagacctctacttctcaataagttagggggcggaggaatgggtctcaatctaccactcacttttctgctagaatttttttttatattgatacctcccattctttttttattttattttatttattattattatactttaagttttagggtacatgtgcacaatgtgcagattagttacataggtatacatgtgccatgctgtagaatttcttaatgttgcatcagtgtttcacaatgtaatcgaaaactcaaaatagcaatcttccttttttattttattttattttatttatgttttgagatggagtctcactctgtcgctcaggctggacagtgcagtggcatgatcttggctcactgcaacctccagctcccaggttcgagtgattctcctgcctcagcctcctgagtagctgggactacagatgcatgccaccatgcccagttaatttttgtatttttagtatagacggggtttcatcatgttggccaggatggtctgaatctcctgacctcgtgatctgcccgcctcggcttcccaaagtgctgggattacaggtgtgagccaccgcacctggcctcagaacagtttatatttaaaaattatttcaaagataggagagagttcccatgtgtctcatatgtttcccctattaacatgttacgcttgtttcattgatgtaccaatattggtacatttttattaactgaaatttatactttatccagatgtctttggtttttctaaaataccctttttctgttccaggatctcacccaggaaatcacagtacagctagtactcatgtgtctcaaggttgttcttggttgtgacattttctcactttgttttgatgaccttgacagttttggggattactggtcgaatgtttgtagaatgtccctcaattagggtttttaaaaactgatttataattcacatagtataaaatttacccttttaaaatatataattcagtgcttttgagtatattcacaacgtttcccaaccatcctatggttggaaaattagataacctactaattccacaaaatccagaatattttgatcatcccagaaagaaacctcataaccaacagcaattactctcctttcactcctctcccatcccctgaaaatcactaatctgctttctgtctatatggatttgcctattctttttttttttttttttttttttttttttgagatagagtctcactctctcacctaggctggagtgcagtggcgcaatctcggctcattgcaacctccgtctcctgggttcaagtgatcctcctgcctcagcctcctgagtagctgggattgcaggcacgtgccaccacacccggctattttttgtatttttagtagagacaaggttttgccatgtcggccaggctggtcttgaactcctgaccttaggtgatccacctgcctcggcctcccaaagtgctgggattacaggcgtgagccaccacacttggcctggatttgccaatccttaacagaacatataaaaagaaccataaaaacgcctgacatgttgcctcatgtctgcaatcccagtactttgggaggccaaagtgggatgattttttgagtgtaggagttggagacctctctgggcaacatagttagaccaggtctctacaaaaaaataaaaaaattacctgggcatggtggtgcatgcctgtagtcccagctactaaggaagctgaggtgggaggattacttgagcccaggagatggaggctgcagtaagccatgattgtgccaatgcactccagcctgggtgacagagtgacactctatctcaaaacaaacaaacaaaaaaccccataatatgtggcctttttctgtctagctgctttcactcagcataatgttgtcagggttcttccatgttgtttcatgaatcaacactccattcctttttatagcagaatgatattccattgtaccatgccatagttgtttcctttttcttttctttctttctttttttttttggagaacgggtctcactctgttgcccaggctaaagtgcaatggtgtaatcatagttcactgcagcctcaacctccctggctcaagcagtcctcccacctcagtttgggtagctgggactagaggtgcacaccactatgcctaactaattaaaaaaaaatttttagtagaaatggagtcttgctatcagggagatcttggactcctgagttcaagcaatcctctcgccttggcttccaaaagtgttgggactgcaggcatgagccattgcacctggcctcacattttgtttattcattcatcagttgatgagcatttgagttgtttccagtttttaactttttttttttttgagacggagtctcactctgtcacccaggctggagtgcaatggcagggtcttggctcactgcaacctccgcctcctgggttcaagcgattctcccacctcagcctcccaagtagctgggactacaggtgcgtgccctcacacccggctaatttttgtatttttagtagagatggggtttcactgtgttggccaggctggtctcgaactcctgacctcgtgatcagccagcctcagcctcctaaagtgctgggattacagtcatgagccaccaccagttttttagctattataaataaggctgctatgaaaatgcatatacatgtttttgcattaagatatgttctcatttcttttttttttttttttttttttggtgacaggttttgctccatcacccaggcggagtgcagtggtgccatcacagcttactgcagtctccacctctcaggctcaagtgattctcctacctcagcctcccgagtagctgggaccagaggtgtgcaacaccacatttggcttttttattttttattttgtagagacgagtcttgctatgttgcccaggctggtctcgaactcctggattcaagcgatctgcctgcctcagcctcccaaaggattgggattacaggcttgagcccctgtgcccggcccctatgttttccttttttttttttttaaatttgaaacggagtcctgctctgtcgcccaggctggagtgcagtggtgcaatctccctcaccgcgacctctgcctcccgggctcaagggagtctttagtctcagtcccaagcagctgggactgcaggcgcccgccaccatgcctggctaatttttgtattttttagtagagacagagttttaccatgttggtcaggctgatcacgaacctcctgatctcaggtgatccacctgtctcggcctcccaaagtgctgatattacaggcgtgtgaaccaccgtgcctggccgttttcatttctttgtgatctgcttaggagtagaattgtaggtcatatggtaacttcagggttaacatttgtaagcattgccaaactcttccactgtggctgtgctgtttcacatcccaatcagcagtgttagagggttccaatttctccacctcctccacaacccttgtcattgtctttttaattctagccccaagtggcatctcattgtggttttcatttgtacttctctaatgacttaacgattgtgtcttttcatgtgcttattggccattggtatttaagaactattttaatcctttgcccattaaaaaaaaatgtttttgtccttttattgttgaatagtaacacttttttttttttttgagacagtctcactctattacccaggctagagtgcagtggcgtgatctgggcttactgcaatctctgcctcctgggttcaagggattctcctgcctcagcctcccgagtagctgggactacagacatgtgccaccatgcccagctaattttcatacttctaataaagacggggtttcaccacgttggccagaatagtctcgaactgctggcctcaagtgatctgcctgcctcagtctcccaaagtgctgggattacacttatgagtcactgcgcccagccaagtactaacacttctttatacattctggatactacactcctagtagctttatgtttagcaaatattttctcccattctcttggctgtcttttcactttcttaatgtcccttgaatcgaaaacttttatgtaactgtgatgaagttcagtttatttattatttttggttgcttttgttttaggtgtcatatctaagaaactgttgcctaattcaaggttacacggatttatatatatacacacatatatttatacatgtatacataagtatacatggaatatatgtgtaaaatatacacatacacaaatgttatatatcacatttatacataggtatatatgtgtacctgtatacatatataacatgtatatatatgttctataacaagtgacttatattttattgatctattttgagttaatttttgtacatggtatgatgcaagggttctgattagtttttctagtctcctttgtctattctgtacagaatagttttattgcagttttagtgtcctttaagtacataaccttaagtgtttggcttggggataaatgtagactttgggaaaattgaattgttgggagacctatcagggtctactagcatgtcatagtggagtttagtggcaatgtctccttctctgtatcttcactccccagttgtaggatatgttgaatcagacctattattaactaacataaaatataagtgagcctaatggcagttctctttagattttctgtaaagcccaggacacccattgtgacctctcagactccaaagcgaatttcctaatggagtagaacaaacaggaaattatgaggaaaggcagtcagagtttgaaaagagaacacaccagaaacaatggaagataggtccaagaaactagataagtgcgagttgagaattgaatataattttatttaattttaataatactttaattgtaaaagtaattcataatcactgcaaaaagtaccaagcactgtaaaaattaaaaatacaaaacaatctcaaattgtgacagccaagagaaacctaaagaaacatgattataatgtttgtggcatgtaagtttggtgtccacaatggaaaaaggatattaggaaaaaaaagaaatataagatatagaaattagttaaaacaatgagaataaaaaatgaacacccaattcctgctcctagaagaagtagtactctaacatttggtgaagttctaagagccaacatttttacccagcttatactaggacctgttctaaatagtattttagctcatttaattgttaagccattgtataaagtaaacagaatcccttcttttgttacagattaggaatttaatgcacagagggttagataacttgctcaaagtaacattgtggtcaagagtcaaagctagaatttgaatcaaaagagcctgagtccaaaggcatggttttcatcactggactataatggtgtgtattctttcataattttttcagtgtaaaactgaacatacagtatgcttttattttatttatttttttgagatggagtcttgccctgtcaccaggctggagtgcagtggtgtgatctcagctcactgcaacctccgcctcccacgttcaagcaattctcctgcctcagcctcccgagtagctaagattacaggcatgtgccatcacgcccagctaatttttctgttttttgtagagatgggtttcaccatgttggccaggatggtctcgatctcctgacctcgtgatctgcccacctcggcctcccaaagtgctgggaatacaggcgtaagccactgtgcccagcctacattttatttttcgattgactcccgtgatcagagtcaacttcccatgttattttatgtgaatatgtatcaatgaactattagaaattgcaatgtttttgtaggtcaaaacaattcaatattgacaattttatatgattcagcctaatacatcattttttccatcagccatattgcatgttattatttatatatacgtttatttagttagcctatctgttctctgtgaggaacattacacagtttctgagattttgttacgatagaagtcagcattgataagcctctgcgcacctgttttaatgtaggatcattgggaactgagcagtagcttacagggcttgggaggggatttaaccatttagtcaacctccactcacatcaccctcccttcttcgataatgggcaattgagaaagggcaaatgtgtgtaaaaactatgcagatgcagtttcaggattattttcttcttttctgcagtgtcttttcccaagctacatcagcgtctaaattttggagttactgatgcttccgttatttctgcagatagaatattatgtcgtaaataatgtttacttgtccattagtattatataaaagtgcctgtttctccccactccagctatcattgattattggtaaaaattttaatgtatccaattctaataggcaaagaaaggctctcctacttagatcttaggtgggggtctaagttcatatttttgttttacaaaaattgaatagccagtgtttttgagttgaatgatctatccattccgtataggagagtttaattatattgtgattttgggggagataattttcacaatttaccccctcaaaatgtagaaagtagaaaaagggtagaaaaatcgcaccaaatttgaacaatgtagcatgcttttagagttagggatattttcttttggaaggatttcaagtctggcgtatttgcattgattgtggttatggcgcatttaacttttccaaaccagcttttttgtaccgcacataggaagacctgagggtgagtgtaaattaggattgtttggccagtggtgtgtgcaaaaatttattgtagaaccaagaattatttctttagtattttacacattttaaaaaacaggtagacatgtccattgatcccaggttgcttatggtttctagaggccccctctcattgcaacagtgctgtggggccctaggggtccagtagccccctccccccaggtcattccggtgagggagggagctgggacccctgcactgcggcaaacaagcacgcctgcgcggccgcagaggcaggctggcgcgcatgctcaggcggggatgtgtgcgaagcctgccgctgctgcagcgagtctggcgcagagtggagcggccgccggagatgcctgacgcatctgtctgaggagcggtcagtgacgcgatggagcgggcaaggtcagctgtgccggtggcttctctcaagagacagcctggggagcggccacttttattcatcagatattccaagtttttaggacttggagtactgaataaacggaatttgggccctaaagtcctttgttctggagaaccagatccggaatgttcagaggcttgctgttgtgccgttctgccccgatggtatcctgtccgctcgcattggggcgcgtcccccatccgcccccaactgtggtgtcgcgacaggtcctattgcgggtgtctgcggtgggaagggcggtggtgactgggagcatgcggggtaaccgcagtgggcaagggacatgggtggaggtgggtacatcagggtgattgcagttccgtgtggcgagggtacgtggggggaccagtgcatagggattttaggcggaggtaggtatattggagtgattgtggcggggcgaaggtacgtgaagtgatcggtatttagggggtgttgagcgcaggtaggtgtataatagtgaccactgcgtggtggagcagggtacgtggggcgactggggggggaattcgtcgcagtgaccgaggcgaggaggctatggcagtggaccagggggatgagtcggtgtgacagtggtgggggttgtgttggtggtcgcggcgcggggagagtccgtaggaagtggctgggaggtagggggaaggcggcgacagtgggtattggcggcggtgggcattggcagcgggtaggcatggcggtggtggactttggcggcggtaggcatggcggcggtgggcatggcatggaggcggtgggcatggcggccgcggggcctgtcgctgtccggagtgactaagggacgctgaatgattgctgtgtagaggagggggcatcagaaggggcagtagcacagtccgcagcctttaattttcctgtgacctgcgatggtcatctggtttgcctactgtggtggtggtgcttttttattaaaactgcgcaatgcctacactgccgcaggggctgcagaaatgcgtggaatccttgcgtaccctttaggaaccctcgctttagaggctatggcataagaagactggaatgatgtgcagaacttgcatttacagatcttttgactgataggccaggtgatgcctgggggttacttttttttcattgtttctctctgttgggaaccaggtcttggaaggctatgtcgaaataacctgggggtctgtgttgcgtcactgccattgtgcagctccttcaagatggccgccgctgcagcggcttagatctgcgcaagcgcttcagcgggggggtggccgcttcctccctgtagagccgccagtggggagggggcaggtggtgtgtgttcagcttctgctgtttcggagtttcagccgtaccctctttagggtgcagtggtaaggagaggaagccggccaaggtgggcggctgccccctccccaaagtgctgcttgggaaaggatgcaggttgcgcagacgcagcagaggtgacagtcgcctccgcttgcagtggggcgagacgtggggcaggggagcgagggcttacgcagcttttgcctggaaggaatggcagccctccccttcacctggctgatacagcagctgttcctttccggttgtggcgcagtagaggggggaggagggagatgggttggcgcaggctccgcctagcaagcttggcagccaccccttacccacggtgcagcagtagaggactggaggggaatgtggctagaggccaggcatttgtaccacctccgcctgtgtgggatggcagctgcactgggctactgcttttcagctctgcagtaaactagagtggtggcggcctggaggccatcaaaggtgcagccaccccaagacctgctgtgctgtttcagcaagcctccattaatgatagagattttaaattggttttctgactccctggaaaatcgtaccttttcatttttgtagttcctctcttggttgtattgtgcgctaattctctattttcaaactggacttgttaaccccttttttttaactccctgtagtctttgatttccattcgacacatttaataaatgtcaccatttaagattcagttatccttcttaatctctggatagtccattctgatgcactgcatactttccttaaatgggttgggggagaggacatcgtgatggctcttcccgactaaggttgaaaggtgtttcaaacactggacctcttcatcttctgggagttgaaagctgcaagttttgtgctcaaagagaataaaagagaaaagtggagacaatcttattggggtggggttgtgctttggatcagttactgtctttttttggatttttaaattaatgatcatttttgaagttggagctactacaaaaatttggtgagaaaggttaatgaataactgcatttttatattccagtacttttttaaaaaatcattttattctaaggattttgtcttcctttgcaggattttcagtgcttgccttttctgtatttacattttccctctatcataactggtatgtctggttgcactgagttgtaattaacagaaaagttaaatctacgaagcccgaaaagccttgttctggaataatctatttttgggtagttttaaaaatagcaggagtctgggattttatatgatatttataatttacccttttttttctgcttgcatgaagatagcagttcacatacatatatttcttggtttaacttctggtcatttggctatttgcaagctgagtatttagtctgatccgccattttgtagtcttgcattcaggcccgggatcctaatatggcagatccctttggaaaggcctcttgaagtttcaaggtctgtgtcctactcagtgaattggctctgtgctagggctttttggaggcagggagtggcagcccttcctgtgatgcagaggaaggaagcttggttgagagacccttatgttgttgtctaaggcagggtactaactgatttggatttattcacagaccttgccttatcttgatttcactattctatctgaccagtgtgtcattgccgaaatgttttccacatttatagttactctgtatctttatgtttcccttaccctgttccttttcctaataaacatctttgttttacaaaaaattttgtttataaggtgtcaaggatgccaagataacctcctttgtttatcagcgccctctgtttagctattttttaggaagaatcatttaagcaggttgtgagtactgccctcaattacttggacaatgaagttttaaaaatcttatttagacctgtcactggtcctgtctcctttttttttttttttgtggcccagggccagaaagcttgagtgagaattgttactacttaaggtagcctctctccatttctggatgctagctggctcaaagttttttttttttttttttttttttttttttttttaaatagaccagggtctccctatgttgtccaggctgaactcgaactgctagactcaagctatatcctctccctcctcagtctctctctggccactgtggctggcccaaattctctttttgttaattctcctcagatttgttttggaggcaatgaggtttcttatattcatggggtacagattagcagcctatcattaaccttatttttttgtttttaggagacagggtctggctatgttgcccaggttggagtgcagtgatgcagttatagctccctgtaacctcaaactcctggatcaatctagactcctgcctcagcctcccaagtgcctgttagtacaggcttgaggtactgtgcccagctaactttttatttttttgtagagaggggtctccttatgttgcccagactggtctcgaactcctggactcaagcagtgcccctgcctaggcctcccaaagtgctggcattgcagccatgagccgctatacctggccaactttgtttatttttattcttgagatcttagttaaattttatggaaaatttaggccgtaataaaattgggattccattgctttttgcttttcaatatatttccggattattactttcagtgtaagtgatctgagggcaaacatttaacaccctttctatatgatgattttttcatgatgtcctcagtttcataaaatgttggtttctgtgttggggatgcagttagataaatgcatgtgtgtgtgtatctagaacattcaataaagtagtgttttcaaaatcttatagatgacattttatatgtagattaaaaataagtagatttaagccaggtgcggtggctcatgtctatagtcccagcacttttggaggccaaggcagaaggatcactggagcctgggagttcaagcttgggtattgagaccccgtctctacatttaaaaaaaggtaaattcagaaagttgaaataatagaatattttggtttgatggctatttcctcagttgacctcagacctttcatattgagcaactgccgaatgggttctttttgttttttggtaagacagtgtttgcagttgtacactattagattaatcatggtttagttgatagtttctttaattgtattatattaaggtactacattattagctgtatttgtgtgcccaccataatgtagcactgatcagtactaaattcctttttatggctgaaagacattcgtttggatatatcatattttcttcattcgtaagttgatggacatttgagttgtttccactctttggctattatgaataatgctactaggaacacgtataatacgtttaatacaaagaattagtttcacaaggttttacttagccctcgtatatgccaggttcttgaaattttgtctttttggaagtatgagagtagtggtagctgggaaggctgcaggtataatagaaagaacatgaactgtctgggcatggtggctcatgcctgtaatcccagcactttgggaggccgaggtgggtagatcacctgagggcaggagctcgacatcagcctggccaacatggtgaaaccctgtctctactataaatacaaaaattagctgggtgtggtggtgcatgcctgtaatcccagctactttggaggctgagtttgggtcttgtaatattacttcatctagcagtagagttagtgtcatatgttactttcatgattaacatttttaggaagttggcaaagtctatatataacactttatgtttccaccagcagtttccccacatcctttacaaatattgtggtgtcagatggtggcatttcagtgggggttttttcattttgaggcagggtctggctctgtcacccaggctggtgtgccagtggcatgatctcaggtcactgcaacctctgcctcctaggctcaagcgccctctcaccttagcctcctgagtagctggtaccacaggcatgcaccaccacacccagctaatttttgtatttttttgtatagatgttgcccaagctggtctcctgagctcaagtgatcgctggcctcagccttccatgaaccattgcgccctgcctcattgggattttgatttgcattttttagtgactaatgttcagcatcatttcatatagattagccacttgtatgtgtttggaggactgtctattcaagtgttttacccatcgtagcaatagaatttgcccttttattgttgagttgtgagagttccttacatattctggataccaaacttgaaaaaatacttttttgaggtgtgagtgacatacaaaagctgtagatagttaatgttaaaagttgatatgctaagagataagtacatgcctttgaaatcattcttatcaaaattagtggcataaatgtgtctgtcacctgaaaaagtttctttgcctctccctaccttcttttttttcattgtttggattttctttttgtttgttttggatactagaaacttagctgtatgttaagcaaatattttttcctattctggttatcctttcactttctttagtgttttcggaactttattttttgatgaagtccactttattttttatactgcttgtaattcaggtgttatatttaatagaccattgtgtaatcaaaagtaataaacattatcagtgtataaaattttaccatttagaaatcaaatatgtgtgtatggcttgattagaacatttaaactcttgaaagaataaaacagctgtgcgttattggtaagctattttaccaatctaaaagtctaacatgacttaaaaacatctagggttcagagaattattaatagcttttggcatgtatctttgaattttgcttttgagatattacttgtgttactttagtgaaaggtcctgctgacctttctgatttatcatctttaaaggttcataggtggtttctgcagtccctaatatggctagtctggtgtgggatttcatgttctgttcccttgagcagccattttatgaggggttctgcagacgtaacatggcgggttttttgtttgtttgtttgtttttgctatgtggatagtttttagcttgagcagctcttctattgctttgcaaatcctaaagaaagcaccatttgcatgtttttttaaagtagatattttataatttaaactatgttctattccactatataagtatgtctactgtatcctaaaaatattttttgaaaccattttggaaatcaggtttactgtttttggggggaaggtgagtagggtagtggtggtatgtatgtatctacatctgcataagtgggaattttatatgtacgtgactacaaatagaggtagatatattattttaatttcattttctgattttttttaaaaccagattttctgatgtcatgggcttctaaaaggagaaaaaagtggttatagcatagattatgactgtttgaaggttaaagatcttgtaataattttaccttgttttaattagatttaaaaatccattatattaaatgtagttctaaatataaccttgacaaatagttatttcatagattgatgcagtctaccaaacaaatgcctctcttttctgtttcagggatcgcttacacctgagacgaactacagaacagcacgtaccagaggtggaagtccaagtcaaacgcagaaggactgcctcactgagcaaccaagagtgagtacagactgtgttgggaacaaatgcaagtcagaatctcctttcagattagaacaaaatatcatgcaatgaggggattaaaatgaacataattgaagaagcagacacatctaatacagaagatgtagtaaaaaagcaatgaaattcttaaccatattatcctaaaataattcaccctcttaaagattttagtataattttcttttttcctatacgtgggtaagtgcattttatctttataaaattttgtaattacccttcaacataagcatacttaaatttttctgcattattaaatcactttgtatgcttgcaaaatgtactgtgcgctgaagtgattaatttacatattcattcttgctctgtgatatttaggtgtttgtttttggttagtgcatttattctgttaaaatttaaaatacatttgtgttttttatcctgttttaagtatatatatgtggaatgtatatataggatgtatacacagacacactcagacacatattttaatttagatttctagaagggaaattttaattaaaaataggtgaacattttaaatgacctaatacatatttagtccacattgaaactttggcattttgtcattgccattaaaattttgatggcattaaaatttgatgccattaaaattttgatcagtaggtagcatttttttcttagctacaattgttttttttaattataagtattaaaaattcatgaagatgattctttttgtaaaacagttttgcataaaaagtaagtctcattttaaagcaactaccaacttaactggccttttcctccccagagataatcattaagtaaatagccatcagaccttgtcctatgcattgtgtgtgtagtggggagagaggaagggaggacatgggacacatttgaagtttgtgtgcatacgacaccgtgctgtctgtattttgacaatatgtcttggtgatcttttcatatcagtacacataaatctaccttattttacaaagtgtgcgtggtgtgataacattattattgtaatcgttagcttgctgctggatatttagtttgtttgcattgtttggctattaacaatgaaaagaacagtcactttgaaaacgcagtgtaggccaggcatggtggcccatgcctgtaatcccagcactttgggaggctaagccaggcggatcacaaggtcaggagttcgagaccagcctggccaacatggtgaaaccccgtctctcctaaaaatacaaaaattaaccgagtgtggtggcacgtgcctgtaatcccagctacttgggaggctgaggcaggagaattgtttgagcccaggagacggaggttgcaatgagctaagatggcaccactgcactctagcctgggtgacagagcaagactccatctcaggaaaaaaaaaaaaagaaaatgcagtgtatgaatactaatttattttatttttttcaaattaaaggtttttcctcatagtaaaaactgagtagtagtttgtgtgtcttttgttatttcctcattttatatgtgaaaagttgagctggatgtggtggctcatgcctctaatcccagcatgttgggaggctgaggtggatcacttgagcccaggaggtggagaccagcctgggcaacatagagagacctcctctctacagaaaaataaattagccaggcgtggtgttgtctacctgtagtctcagctacctgggaggctgaagtggaagggtcacttgatcccaggaggttgaggctgcagtgagccatgtttgtgccactgtactccagtctaggtgacagaatgagatctagtctcaaaaagaaaaaaaaagttgtaaaacatctgttagcaagttttaaattatggtgagggtaaagattttttttttattttttcctatttattttgccgatttttactatagtgagtatatttaagtacattttcattttttaaaattgctttggaagacgtattttatgtacgttttgtttgtatattggtaaatattttgaaagtattttgtgtaatataatttgtcctttatatataataggttattcgatcattcattttatttgatatgaaatctcttttttcatctcttcattctttttgagacggagttttgctcttgttgcccaggatggagtgcaacctccgcctaccaagttcaagtgattctcctgcctcagtctcccaagtaactgggattataggtgtgtgccaccatgcctggctaattttgtatttttttagtagagacagggtttctccatgttggtcaggctgggctcgaactcccgacctcagatgatccgcccgccttggtttctttcccaaagtgctaggattacaggtgtgagccactgcgcccagcctctcccttcattcttttgcagctctgacgtttttttaaagtgccattactattccctgagtttctagaggtagttcagagatggtggtggaggtagggctgaggtttaggactcttaggtttaggactgttaagtgggtgaaggttctatcttgctatatttttgttacagtttttttcctatgtaacctcagtgtggactaaataacaggtagtctcatcctcatcttgttgtgggatgacgttagccttctaggcatcttgtccatatttatggaaacattttgatggttttgaagaagaaataacttgagtttttcttatctgcactgcatatatatgtacaaatactgcagggtcttgagttgggggaatgatctgagtaaagtgtagagttagggaaatagtataatttttcccccttgtgcgttttcattttgagagtaattggattatggaatgggtaagcaggattggttaacactgcctcattgtccatgtgtttaggattctcaggattggtatacttagaatgttatactagaagtgttcaatatttacccattcatctcctacttcctaccaaatcataagtagtattgggaggcagtcttcctggaggagttgtgtggttattagccctaaagatcaatgaaggaggctgggtgcggtggctcacgcctgtaatcccagcactttgggaggcgaaggtgggcagatcacctgaggtcaggagttcaagaccagcctggccaacatggtgaaacctcatctctagaaaaataaaaaaatcagccgggtgtggtagtgtgcacctgtaatcccagctactcaggaggctgaggtggaagaatcgcttgaacctgggaggcaaaggttgcagtgagccgagatggtgccattggctgtgcctgggtgacatagcaagactccatctcaaaataaagtaaaaataaaaagttcactgatttattttaaattttttattctgtctttcagtgtatttgtcactaaattagctcttattctttggggctggatgatgtatcgtgagttcgaagggaaattggaaattggagctggagagttgtcttaatatattttatgctaagcttcacatgtcttttcaaattaatattctgcactctatgaattaaattctgtgtaggctgcctcattttctcagtctttaatcttctattgggttacaggttagatctgagggggacattgcaatagagaattatcttacgtttcaagataacattatatatatttttttttactgaaacactttttagacctttatgaataataatcagaaacttagttgtcatttgtaaacagaggttagagtggagaatgcccaaattaagatttatttattcagtgattagactatgaattagagtataaagtagactatgaattagagtgtgaagatttagaggtatgtgcagtgcaattctgactacttggagttagtgcaaatttcacagttgtctagatgccctccagaacattcccctcaatgcagacaccaactccaagctccagggttggcagggcacccacacttccgaccaacagtctatagattctgaggtcctactattttctcagactttataattgactaaggttttataaatgactagtagatctcaagaaagtgctatacttactagttttttttataaaggatacaaatgaacagatgcatagagcaaaatctgggcaggtcccacacaaatcttccctgtcctcaggatgcattacctgcacattagcgtatatcaccaatcaggaagctcaccagaactccagatgtcgatgatttttgttggggattcattatgttgacaagattgaatcactggacatgtcactgaattcagtcagcaactctcctgccctcccaggagggcttgctcaaaaccccaaccctttagtctttgtttgatcttttgtggcctggttagtcaccatcttgagacatctcattaccaagaactcaggtgtgatcctagggacccaccttgagtaacaaacacatttctttcactgggtaaattccaaggatgtataggatgtataggttacttcccaggaaccaggagcaaaggccagttaaattctttattatacagaagcaattttaaaatgttactgaaaaaccatagaaaaaagtccaatttccaaatccttacatgccaacaagggcagcattgttggtgatcccccagctcctcacctcaaggcaagctgtcatttcctgtatgtcttccttctcatcatcagatttcacagccaggttactgattcataggggtatgtcgagggcttttgtctggaattccctgcttaccagtagatgattggtttacatattttaagagcccttaaatagccctggaagttctatatttcaggtagtgacttgtcaggaggatcaatatgaaggacggcctaaacatctccctgcaaatgctttagcagcatctccctcccctcacccctggggagaaaggattgttcacacaggataatttgaaagtgagtgactatatatggtactgatggtgtttcttcaaggctgccagctcttgtgtttttagttcttttggaaatatttctagacttggtaagtatcttaagtatccactagtcccttgtacaatctctgtgtagagattcctgttttgtgttataatttctcataagatagtgtcatcctctgaccctaaagaaagatcttcttccctgggcgtggtggctcacgcttgtaatcccagcactttgggaggccaaagtgggtggatcacctgaggtcatgagttccagatcagcctggccaacatggtgaaaccccatctctactaaaaatacaaaaaaattagccgagagtggtggcaggcacctgtagtctcagctactcgggaggctgacactggagaatggcgtgaacccaggaggcggagcttgcagtgagcccagatcgtgccactgcactccagcctgggcgacagagtgagactctgtcttaaaaaaaaaaaaaaaaattagctgggtgtggtggtaggtgcctgtaatcccagctacttgggaggctgaggcaggagaatcacttgaaccccgaaggcagtgtttgtggtgagcagaaattgcttcattgcactccagcctgggcaacagaatgagaccctgtctggaaaaaaaaaaaaaaaaaaaaggaatatcttcttaaatgtaagggtacctagttttctttcatatggtttcctataaagacaaatgtatttttatcatttatatatattgtgctcttgttgtaggtgtcagttgtacccgaggcgttctcagcagcagcaagtacctgtggtggatttccaggctgaactgaggcaggcattcttagctgagacaccaagaggtggttaaagccatattggagtagcgaggaatctgattccaagcaaaaaccaggttagagctaatgcagcaatgatcaagaataaagaatcattaaagaatggggtgttgggggttctcttaattatcagtgacacattaatttttttccttagagcttcatacaataaacacattgcagaaagttttagaaagttttgcaggaccttaaattttctgccctgacactttcgtcatgtttctgtattccagttattgtagcgcatgcttttcaggtagttttcttttgcgttttttttaattatataaaaatatttcactataaatggctcttgaataccctgttactgaatgtttataatttccttttgtgggaggtgtcatttttttctgccagtagtttgaacaaagctttagtagatagctttgtataaaacttagaataattttttcaaatatgcagatgtgaaaataaattgaatcaaggaatatgaacttaaggtacatttttctaaattatattgcaaagtattaaattagtattcattgctttcgaaaaataaagggccagttacaacatactttcacagcattattttaattcaaatatggtttatgtcagtgaattataaatacacagcacataattaacaatgagtattagagaatctaaatactttctcatgcttatttactaattcctttttgttttgtctttttctcacttttctgttttaaccaatgtatttcctctttgaatcagcagacaatgtaataaaaatattattcataatttttcaatgtgatgtagatttatttagttctttttatgttgctttcattttttaggaaaaagttattacaaagtcgattttgatttgttttcttgtttttcctctgtgatttttctttttttctactttaagttttagaatgccctcatttctgagagtttactatttactttttacaaagtaagagcagagaggaattgggtttactgataaattccttctagcctttttttaagtctgtttttgaagtattatccttcaacttgaatcagttaggcttgtttatggccaccattttgagttattaattaatttatttatttagagatgaagtttcactctgttgcccaggctggagtgcagtggtatggtttcggctcactgcaacctctgcctcccaggttcaactgattttcctgcctcagcctcccaagtatctgggattataggcacccaccaccacacctggctaatttttgtatttttggtagagacggggtttcaccatgttctccaggctggtctcaaactcctgaactcaggtgatccacctgccttggcctctcaaagtgctgggattacaggcgtgacctaccgcgcccggcccattttgagtttaaatcaaaggagacagaaattttctgagaaatcctcctttcttgaatcctttatacacaacattttctagcaattgcataagcaaattggaatctaatcattgtccaaagcttttcccttgagtaagggaatttttcattgaataggtgtgcacaactgattttttactttttaggaattttttagcttctcagttcagttcacagatttttgtaaatttttaaatacaacatttaagtcatacattatagtctgcaagtaggaccatctaattttatgatacttaattatatcttattctagtctcaactgctagttctacctaaatagtacccattactagtattcctgtagaagaagggttggtaatatatctggaccactacctgtgtctataaatgaaattttattggaacacaactcagttcatttattatgttatctttggccacattggtgctacggtggtgcagctttgagtagttgtgacagattgaatgacaggcaaagcctaaaatacttagtatcttgctatttaaaagaaaataattggctgagttttattttagaggagcagattgaaagaagaaaacaccaaagtgggggccagtcaatatagtcataatgtcatagaaggtgataaagaatagattatagaagtatatacgaagtatacattacagcgtagacaatcagatgaatttcttggggaagggatcagtctaagagtcatgttaaagtctgctgtggaggaagatgggtagtctttaacaacatttaaacacttcgtacccgttttcattaaaaatgtaaggcacacgatggccaggaaaaataagaaaataaactattaatgtggccgggtgtggtggctcacgcctgtcatcctagcacttggggaggctgaggcaggtggatcacctgaggtcagaagttcgagaccaacctggccacatggcgaaaccccatctgttctaaaaatacaaatattagccgggtgtagtgggggacacctgtaatcccagctactcgggaggctgaggcaggagaatttcttgaaccctaggggcagaggttgcattgagcagagattgtgccactgcgcttcagcctgcgtgacagagcaagacttctatctcaaaaaaaaattgtgttatgaatattctgtttttctttggtacctaaatatttaccagggtacatatccaactggatacctacctagtagttgggatgcagggtgtaatattagtatgacttttaaacgtttttgttacattgttttctaaacacatcatgagaagtgctgatggccactaaaaattagtagaccattagtttctcagtaccaccctttgtattctggtgtttttttgtttttgttaaataaacctttccaataaaggaaatttgttttcttgtgtttttaattggaattattgtgtattaatattttgcatttagttttcttttgtcacttgtttttgcatactcttcgatggaggatctctatggagaccctctataattttaaattttaacagatcaatactgatattccatggtgtgtctcatttgctatgtgtgccttggccaaccctagtcatcttattttactatttgctatgtgtgctttggccaaccctagtcatcttattttacttttgaattaaagtagatttacatttttatgtagtttaatcatttgaaagtctacagtttcctaaagtttgaaaacttgtgcttctgtgagggataccagttcgttaatttgcttatgtgccctttgatctcagaagatacactatgactgctcatccatccttgcagtgtgatgttgctactctcgtcgcctttctcatgaagttttgttttcttgtgctgtaaagataaatttgaccactctgcagtgatttattttcttctttcacttacaaggtcatgactacattgtatcacatttagggatgagagagaactgtttctaaattccaaatctgtctcttaagggaatccttttaactgctgtaggaggtcaactcctattgtgagtaaaacatatatctcttctagctatacaggttattattatattatgatatatatataaatataaaataataatctgtccctaattctctaggtcttcagttctttgggccataactcacatccctagatgtgtttcatacctctggaccgctaagcttgtgggagttatttatatcctattgctcaaggtcattgccaaggtctgatttttcacaaaaaaattccaacctctggcataaatgggttaaaaacggctttagtgatgtagtgctgataaacataaaattcacccaatttaagtgcatgaagcaatgatttaagtaaatttacagaactgtgcaatcattgccatgaactactctggaaacattttcatcaccacagtaagatctgtcttgctcattcacagtcatgatccttgttgtctctttggatggctgaaggtcccaagtgttgcagtgctataaaaatggatattgctggctgggcgcagtggctcatgcctgtaatcctagcacttggggaggctgaggccggcaggtcacctgaagtcaggagttcgagactagcctggccaacgtagcgaaattccttctctgctaaaaatacaaaaattagccgggtgtggtggcgggcgcctgtaatcctagctactcaggaggctgaggcaggagaaccacttgaacccgggaagtggaggctgcagtgagccgagatcactccattgcactccagcctgggcaacagagtgagactctgtctcaaaaaaaaaaaaaaaaggatattgctaatgagtctcatataccatgttttcttggatttagactgctttataaagaatcataagataatattcaaaacttctaagttatagtccttaaactcttactcatatttaggacagaaactacatttaatttttgtggaggtctttgtttgcttatttgaaaagttcttttgagatctttataggttttatttaatacattttttaatgtacagacatcagattcatggccactgaatgacagccaggcattagagtattctttttttttttttttttttgagatggagtttcactcttgctgcccaggctggagtgcaatggtgcgatctccgctcaaaaagatacttttgaatccttttcaaaagtaatttgtgtttcattttttaattagtatgataagcacttcaagaccctttacaattctggctagatttggttgccatatttaatagcattttataaataatggagaaaagggaaacattatgcatgcttgattacggtcatgagctgcattaacaattccgttcaacaacagactgcatatgtcagagcagtcccttaagattacaaaaccatgttttcattgtgccttctctctcttccccaccacccccaaccctgagatggagtcttgctctgttgcccaggctggagtacagtggtgccatctcagctcactgcaaactctgcctcctggtttcaagcgattctcctgcctcagcctcctgagtagctgggattacaggcgcctgccaccacacccagctaatgtttgtatttttagtagagatagggttttcgccatgttggccaggctggtcttgaattcttgacctcaggtgatccgcccacctcggtttcccaaagtgttgggattatgggcgtgagccaccacacccagcctcttctctgtttaacattgtattgtgagtgttcatagtatgcaggatagtaacatgatatacaggtttgtagcctaggatctaccatattgcctaagagtatagtagactctgtgtatcctctaggtttgtgtaagtacactgttcatactgtgatgaaatcaccaaatgcatttctcctaatgtgtccccattacgtgacttatttatttattttgagatgaagttttgctcttgtccctccttgttgcccaggctggagtgcagtggcgcgatctcagctcactgcaacctctgcctcccaggttcaagcgattctcctacctcagcctctcaagtagctgggattacaggcacccaccaccatgcctggctaatttttttgtatttctagcagagacgggatttcaccatgttggccaggctggtctcgaactcttgacctcaggtgatccacctgccttggcctcccctggtgctgggattacaggcgtgagccacctcacccggccgttaacgtgatttataactttgtccttcattacttgatctatgaaagttgtttatgtgagtctatatatatatattccatagtcatgtgttctcttttgacatgggaagtcttaggcaggtttataacacacttggctcttagtggggaaagattacctgccatcatcttgaagcgaatttaggggaagaaagaatattgcaaatgacaacataggtatttcagaaaaaaggaaaaatctgaatgaaagagtaattgagatgttgatacagagatgacttcatattaattctgaactagagagagagacactaccttaaataaggatggaaagaaaaatactaaatttgggaaaatgacgcttagtttttgaaacatttaggaattactaggtaaaataaaattcaatgactttcatcagtcctaagtgtgtcaaatgtgagagttaagaatgagggactagggaaatgtggcagtcccttggtgaggaagctagtatgagaggaaggatgtttttgaacgtgtctgtcatagtgattttcatgcaaaattgtctgcctgttttaaaacatggtagattgcagtgcagctttaacatgctttcctctgcaggctccatctactctttgaagcttctgcccagcttgcattgtttctaggagaacctgcgtcatacctttatctatagccttcccctaggtcttcagaagcatcaagttttaactgtggacattggatttggtggaacagcaatcatggtaagctgtatgataaggctgagggttgaaatgtgctgtaagggccgaaagaaatagtttgccagcatgtgcagtgatcttgggttctgaatgttagaaataaggatacatccatggatatggattctcattgcattgagtatcagctgaagatgagctgatttttttatttttatttttttcagacggggtcttgctctgtctcccagtctggagtgcagtggtgcggtcttggctcactgcaaccctgggttcaagagattctcgtgcctcagcctctttattagaaacagggtttcactgtgttggccaggctggtctcaggctcctgacctctggtgatccacccacctcggcctcccaaagtgctgggattacaggcatgagatgagccactgtgcctggccatgagaaatgtttcatgatgtgagaaaatacaggagtttttggtcatgattccaccagtggtgaaggactgtcctgcagatgatggactctcaggtcagattacaatagaaataaagagggctttgaaaatggaagggttttggcattaacagtacagagaaaagcagtctggagagagagaacaccctacatcattgtggtttggtttacttaggggagtggacagtttagagcatgcatcgtcacagagaaggataatcacctgtaaggaggtgaaaattggttcttgagatgtgaaaaaatacttcataatcctttgtggtcctccaaagagccatactaaatatggaagaatgttggtgaaaaaggagagaatatttgtttagttaaggaaaccaggcttagattatgtaagggtggagaagaaacaggagaagattagaagactagggtgttggcaagctgaacatgactcttgtcttactgcttctagactgttggcaagagtagcaagatgctgcagcacattgactatagaatgagatgtatcctgcaagatggccgaatcttcattggcacctttaaggcttttgacaagcatatgaatttgatcctctgtgattgtgatgagttcagaaagatcaagtaaggctgatttgggcaaatgggggttggacacagaggcagtgggaagggaaggccagagctggagtaagggatttccgagggtaactgaagtagttagggaaactatggtagagccagtctattgtttaacctcttgacctgatctctgaattaggtcagagtctgcatctgaactcttttaagtttgtaaaacaatcatggatttattactgggagtaaaagtatatgctatggtcagaatactcgtatttatttttaaaattgagaaaaatgctatattaattaattggttggcttctgcagcagtcttagaccaaatcttggttgaaatggagaagaacagttgttcttcatggttgaggagttgggatatggttgccatttggtatcctctctttgcctatcactgttcccattatttcagttctgtgtcacctgtcattatgatttaattatttaagtaattttttaaagaaatttccattttaatgtggaaacccaggtttcaattttgtttttcttaaaaggtatttcacaaaagaaattagtcttgttgtagtgtaacatcaaaggaacattctgtaaaagactaaagttagattagaaaatagcttcactatttacccttgtatattaactgtgtttacagatattttttggcttgtttttcagtgataactcagtaaatgtttagcatcagttgtcttaattgatacttgaggttgtataaatattttgatgagtgagtgatcactaaaatttatctcactaaaatttaattctgatttgtaggccaaagaatgcgaagcaaccagagcgtgaagaaaagcgggttttgggtctggtgttgctgcgtggggagaacttggtatccatgactgtggaggggccaccccccaaagatgtaaggaagatgtagggcaggacagaactttaatttgcagggacatcatattatgtgagatgtctgaaatcagggtagagcagacacagttcaacatggattgtcaaataaaatgtgccaggcacttaatatcaattgttggttgcctatgctattcgggattaggggatttttggtgaattattctatgtgctgggcattacctaggtaagggtaggagttggtgattcatgtttgcttggtatgtttataaaagaggtgttttcacaatttgacaaataatgtgcattttatacacaagatacctccatggtatacttgcttgtttgttcatttggacacagaactaatatgagataggtgtcatgggaaaatggtggagagaagtgatctctgatgaataagaatactgagaacttgtaaattgtttgattttaggctatgaattttcttgtttcagactggcattgctcgggtaccacttgctggagctgctggaggccctggggttggtagggcagctggtagaggagtaccagctggtgtgccaattccccaggcccctgctggattggcaggccctgtccgaggagttgggggaccatcccagcaggtgaggaaccagcagagggttttatattattgggagaatatgactaagccggaggccgaggagatttaaaaacctaagtgtatgtgtcatacaatgtaaacagcatatggtttaggaggaaccaaaacacagatatatgggaggaagggaataaaactagctgcttaaaatggtcattgggtgattaaagttacccaggttactcttggcaagagtaacttgccactagtggtgagtgaacagaatgcatggatataccacagttgaaaagaccaaagggctttttggatgtcagtgtactaagattagtttttaaaatatgggaataggccgggtgcagtggcttacgcctgtaatccagcactttgggaggccgaggtgggcagatcacttgaggtcaggagttcgacaccagcccggcccacgtggtgaaaaccctatctctactaaaaatacaaaaatcagctgtgtgtggtggtgggtgcctgtaatcccagctaccaggcagggagacaggagaatcgcttgaacccaggagtgggaggctgcagtgagctgagattgcgccattacactccagcctgggtgacaagagtgaaactgtctcaaaaaaaaacatgggaataatgagagaagtacattgcaacagttgtttgtaactaattggtcatttttctcatttattttctgtgtttgaataatgtgaaggtttgcatcgctttgactgtttcccgccctgccttctcaggtaatgactccacagggaagaggcactgtagcagctgctgctgttgctgcgactgccagtattgctggagccccaacacagtacccaccaggacggggcactccgcccccacccgtcggcagagcaaccccacctccaggtaagggattggtgaacacgaagacgaacttgaatctctgatgagagatagcttactgatttaagacacagcctgagagcctaagaatttggggaatatgcttccttcttctagatactggtttttaatgaaagacatagaagagtaattgtcatatagaagttatttgactctatcattgttgtctggcccatttctttagggattatttgggctaaattctaacttttctaagccattttatgaggcctttatttctaccatttttcactgtaggcattatggctcctccacctggtatgagaccacccatgggcccaccaattgggcttccccctgctcgagggacgccaataggcatgccgcctccgggaatgagaccccctccaccaggcattagaggtgagtgggagcataggggtttgatggttcagccaggcccctgaatatgtgtatcctctttttctcaatgtttctatttcctttccaggtccacctcccccaggaatgcgtccaccaagaccttagcatactgttgatccatctcagtcactttttcccctgcaatgcgtcttgtgaaattgtgtagagtgtttgtgagctttttgttccctcattctgcattaataatagctaataataaatgcatagagcaattaaactgtgaggtactgttgtatatatttttttgcctgttgattttgatgagatcttaagttactgtggatgagggtgatgcctattaagcagttgattcaaatcatattctctttaattcttaggataaaaaggttttctgctatctaactttcactttgtgcattgactggtgttggttaataatgttttcatgacccgggggtttaagtggttgtgctgcttcacacatggcctcctgcttctcatgttgctatgtcacattatctgaagggaagtggggatgggatgaaaggccttgtaaggccacctatatactgaaggaagttgtagtgaatcacagtccatgctcattacatatcaaggcatttgaaatagaagttactctttttcttgggatgttgacctcagttgatcaggttttacagtgtcctatgatcagaatagaggatgtgatactggaataatcattttctaccattgagtaagtatttatttataaattactaaatgagtggaagatcctgggtactgggaggcaggaggttgcatatttgagttgataagttgtactactgataataaagataactgacacactaaaacatacttggtacactgaaatacaaattacggttatgtccagtggtatcaccaagtgacaaactgggagctaaatagttcagaaatgccctagtctctaggtccagtttgaattggttatggaacaaagaagccatttataaaagggaagagatttttaggttttgcagctaaggtttatagtaggcagcgagggaatgattcatagtgattgtagcagttggtttaccaagcactaaagagattggtgttaactccataatactgatagactgattggaattacattttttctcttgaatttaccaggagtggttgtgaatgtcaccttttccatcttttaaattacatccttgcaggtggtaatcactcaaggaaaaggaattatcagagtaacaatagttcctgttactgacttgatatggtctctgccagaatagcttctcagattaatggccactctcaggtaaggaaaataaagaggcgaagccttagttgctttaggagatgatataatacaggtgtgacatcagtgttttcagaatttgtaaatgttaaaacaaacttcttgatttaccaaagccacaaccaaagtactttacctggatctttcaagacagagcttctcagttcagacaaattgactgatgataagacaaacacttttcctctacaaaccgtggggtagtatgtagagagacctgtgatttcttcccatactgctctggaactacttctaattatacttttttctttgtttgtttttgaaggggaagcatttctccttgcattggtttgctggtatggatggcccttagattttggcatgagtgattatgcagcctatttgaagaaaacctgttttcaggacctttttaattaaatatggcctgttacatgagttaaaggtaagttataagagctctagattctgcaagatgcttgcttcttgtagttattttgcttggtgataatacattttcttttgtctggagcttcctggactttttgagaatcctgattgtgatgatataataggagaaaacttgggatatagatagtataattgagtgtggtgaatcttttgttatggaatgctagtctaagcttctgtgtgtttccactagggacacacatcaacatatcagtcttaaaacattcttggtagttaatgcttgatgttacttaaaaatcatcctacattcttgcattaaactacatacacgtggctgggcgcggtggctcatgcctgtaatcccagcactttgggaggccgaggcaggcagatcccgaggtcagaagatcgagaccatcctggctaacacggtgaaacctcgtctctacaaaaaattcaaaaaattagccgggcgtggtggcaggcacctgtagtcccagctactcgggagcctgaggcaggagaatggtgtgaacctggtggagcttgcagtgagccgagatcgcgccactgcactccagcctgggcgacagagtaaaactctgtctcaaaaaaaaagaaaaaaaaaaaaaaaagaaaatacatacatgtctcatctaaaacatggttggtcaacaactttctgatttcctgatacacattttattaaccggctccttaaatatatccatgttgcatatcatgtttgacatgctttcattgtagcttatagaataatttcaaatagaattttgggataaaaattatgctaccttaaaataggttatgaagtatttgaggtattctctttttatatgataggtaaacttggcttggaattaaaaagattttgaaagttgcttagggagctccctgcttttgtgaactcattattccttaattatgatgtcaaatttcagaagtttgttattaacataccggtattttgctttttatagattcttgtaatagaatattacaagtagaaactgatttacatagataattatgtgaaatagtgctgcttgactaggattttcatgatctcatttcaaagattagcaaaaacaccctttacctggtatgtttacctctgatactaccttcactgatttcagcaggtagtcagttataatccatggattgaagttttgatttatttatttatttatttgagacagagtctcactctgttgcgcaagctggagtacagtggtgtgatcttggctcactttagcctctgccttccgggctgaagcgattctcctgcctcagcctcctgagtagctgggattacaggtgtgggccaccacacctggctaatttttgtatttttggtagagacagggtttcaccatgttggccaggttggtctcaaactcctgacctcaggtgatccgcccaactcagcctcccgaagtgctgggattacaggtgtgagccaccgcaccccgccatgggttgaagtttttaaatgcatgttttccggtagttaatacattgcttgattctgtcttataattgcatttcagttctcttcatcttgtccatacacataataatgcttagtatataataaagcaaggtatattttcatgggatttttgtagtgggagaatgacatctgagcctgaaataggatatttgtgttgtaactttttcagtgtcatacgataccattttttgaccacttagttgatgcctctgaaaggaagagagaatcagatcgctaaaatttgatgtgtcgtcagtgtggatcctactcagtagtgtcacaacgaggctgaaaatcatattaagtgcttttaggacagaaacgtaaactgctcaggtaaaataaccttataaagagaaataagcatatattgcagaggccttggctaggttcatgatgacacaggaccttgtctgaacataatgatttcaaaatttgagcttaaaaatgacactctgaaatccagtcagtgtgcctcactagacttttcgatttcaagattttctgcagaaaatgttttgaaaactttgaatacttaaaaatggcaggtgtagtattgcactttgctagttgctcagatacccttttttatttgtatagatattctgagttcctttttttttctacatgttgtacgttgtcgaaagctaaaaggaaacttatccttggatcacggaaggcagaggcatttggtgagatggaaacaaggatgtgtaaaaatgagacgaccacctctcggattaaaaaaaaaaagtgccagagttctagggttctaagtgatgtccaggaaggaggaggaataatatttatggagcatatattatggaacacagtgagtatagtacctgcctttaaatgaatactgttggttttttaggacagttgcttttttttcttttttcttcagctgtgtgcagttgattaacttgtacagagcctatcacacaatagatgtttaagaaatattaagtgaatgaatgaggcagcattgctaatttttgtatagtgagacagtatctcacagtccaggctggagttcagtggcattaacataactcactgcagccttgaacacctgagctcaaacgatcctttcaccttatcctccagagtagctgggactacagtcgcgtgtcaacatgcctggctaattttagttttctaatttttttagagttgggatctcactatgttgcttagactggtcttgaactcctggcctcatgccatcctcttgcctcagctggtattgtaggtgtgagccactgtgccaggtactaattttttttatgttagaaaacaagtttttaggtattttatagttacttccttatgacaatatctcatcagaatctaggcctatctgatatctgactccatacgtttataccgtgtagtcagccattcccagatagaggtcatttgagttacttagtgtttaccagcacttgtttactaccttgcgatgatatttacagtgtatttttgggtatggttttggggttatttggttgttgttaaaatgcctgtaatcccggcactttgggaggttgaggcgggtggatcacctgaggtcaggagttcgagcccagcctggccaacatggcgaaaccctacctctactaaaaatacaaaaattagcctggcgtggtggcaggcacctgtaatcccaactacgcaggaggctaaggcaggagaattgcttgaacccgggaggcggaggttgcagtgagccgagatcgcgccaatggcactccattcagcttgagtgacagaggtgagactcccatctcaaggtaaaaaaaaaaaatagaaatcagcaactgctatttgagtttacaggagtgagaagtcctctcttgcatggtgagatggggaacatttaattcaatagaaatatttgagaccaggtatggtggctcaagcctgtaatcccagcactttgggaggctgagttgggtggatcacctgacatcaggagtttgagactagcctggccaacatagcaataccctgtctcaaagatacaaaaattacccaagcttggtggtgtgtgtctgtaatcccagctactcaggaggctgaggcaggagaatcacttgaacctgggcggcaaaggttgcagtgagccgagaccatgccactgcactccagcctgggtgacagagtgagactccgtctggaaaaaaaaagaaaaaaatgagatataaagttcaaaggatgtatttattaagccaatataaagtaaagaggtggggaatgttgtagaagtatatgttgataaagggatcaggtggttgtacaataagaagggggttgcagacatggagaaacagttcttctagctcttccactttcagtatcatctgtgtgggtcactggaatcctttttcacaatgcctgcttgcccatgagttttaagaactagtacagtgtagaaatgattagtaggaaaaacttggctgggttaatttgctttgctgagccgattcaacttaaaaagcgaggtccatactaagtgcccaagaatcaagaaggaggctcacatttgaacttgatgtttagttaatgtgaatcattttctgttgaactaatgagaatacagtgaccttgagggttaggttgtacatctgaattgttcgggctgtttcctgtcttttggatgttttgtttgtatagatattttcattttatgttacatcatttgttctttggtagcaaaaattgagttgaaatgatacagttcctgaaatctatgatttcatgtttcggagatatgtatcaggaataatagtgtgggttctcatgagaaaatctggattgcattactgtgctactttggtttcttgtcagagaagttagtagtttagacctccttcagaatcctttctttggactttgtgtttcttacgttgtgccagccttgattttatttgtctgtcctctgtctttctataccatttgtttacacttaactctagaattttttgatgcatgttttcagtgtactctagtcctaaaattggtttacatttaattattggggagaatagcaagttgtcgatagtatctgtggtggcattagtgtatttctgtttcagttctttggacagtttgctagtggaaatagtcattgtatttagctctgtgagacccgactggcagattgctgtctctctctctctctctctctctctctgtgtgtgtgtgtgtgtgtgtgtgtgtgtgtgtgtgtgtatgcgcgcccgcgtttgtttccttcatgtagattgctgtgtgtgtctttttcttcataattccccttaattctgtgtgctttgaatgacactgttgttgttactgttgttttatatccattgtcacataaaactcttatcatttattcttccaggccagggactgtccttatgggtagagatacactatctgcaggaatttatttttttacgtatttttactagttgatgggaaagacattgggaaagacctgggctggatttgtgatgagctgtgtttactgagcatgatgaagtaaagctcaacgtgattactctgaagtccagccttactgtcagtctaaggactcaggatacaaatactcaaaacataaattcttagactctaaatttcacatggtttttcctatcagtacaggttaaggataatggcgtgttgtaggtttttccagtgcaatacaaggaagttggttctagatcctttagtacagttaatgttttgtagagtgtgttctatgttcactgcattggtatgtctcatctttggcatgatcttggctcaccgcaacctccgcctcttgcattcaagcacttcttgtctcagcctccagagtagctgggattacaagcatgtgccaacatgcccggctaatttttgtatgcttttgtggagacaggctttgccatgtttgccaggttggtctctaagtgatccacccgcctcagccccacaaagtgctgggattacatgcgtgagccaccgtacccagccacacctttgcttatttctactatgcatttcaagtgatcatttcaagagaataagtacttaggagctcctatgctctttttttttttaaccctgttgcttgcatcacccggttccaaccctatatgaaagtttcatgagcatgtttctgtcactgaggcagcttctccatttggcatataattgagaaattgctagtttgtggctgagacattggtttgagaggagacgtaatttatatatttagcagaatgcttaagttacatttccagagattaatttaattctacttttaattaagttaaccctttgctgtatctttacaagacgtaggtggagatttaattttgactcttagattcagttaaggtgatgaaattggcattatatagtttttgatgctgagccccacggagattaaaagatttgctaaacaccatgcaatttttgaatcacatctctaatctcacattattctgtactctattttttgcttgtatgattgatgggtctttcattatctgtgattgacattctatgagtaggtgcttttgctttgcctataagtcgttattatgaaggaggaatggtgaataagaaggtaatttagaaaagcctatattaaatataccatgaacattgaatatagcaagatcttattctctagttgttatcttagttgataaattctgtatgtgttatgtgtttgtgtatacatatgtacatattaatgatgtgggtgttgatactgtgatcacatgacaaatgactggtttatagtgaaaagctgttggggttcagagaaatgaacattcttctaaaagtgaggtagataagttattttatagttcttgcctttgagtctctgttcttctggtagaaatgttagtgtatttataacctctcagatttgtttggttctcttagtgttcttgatccaggcagttagcgatatgttggatgaattgagaaaaatgagtttttcctttcctactaactgaattagattagaaataagcagttaagtgagaaaaatagggaattagtgccagatatgttgaggtgtagtgttgacagggggtcttttaccttcagatgtttggtgcaacttagagaatgcagtggtagttgctggcccagcccatccaaacaacctcatttgtggggtgatacttcacagatgacttaaaataaatcccctgaaaataagaatctctggaagagatgacacgtgtatgtgcgtgtgtgcacgtgtgtgcgtgtgtgcacgtgtgtgtgtgtgtgtgttttggtggagtggtaggaggagggttggcttaatgatgagaatcattatttcttgaattggatgacactttccattcctgcaaagggagcgtgaggtccagccttgctaattcatgatcaaagtaatttgctgagagtagtggaaggaatgagttagcagaagatggcaaattgcattaatgagtagtaggaggaaaacaaataagcaaattttaatgtggttggaacatgttcctgagttgtatgaagggagacaggtaaattgagagtaatgttatgattgtttcatttgttggaaataaggaaaacttgcatggtttgaattgtggaacaataggtggtgtatgttaggagtcagaattatcatttaacatgtaagtttctgttttacttcagataaagaatgtcagctacctttcccatgttagcttctataccttttcttgaggtgaccataaataggtaatattgtctttcactgagattgttttaattagcgaagtgtgctgattaaatgtcttttcttgataaattattagaatgaataaaggatggtatttctagatagccttggttagtcagtgatttgtttaaatttagtgtggataagaatcacctgagggctttttaaacacagtttactgggtcctgaccttagtgtttctggcttattaggtataagtatgagaagttgatttttatcaagtttctagatgctacagatctaggaaccatacttagagtgctattatatgtcttttaatgtacactgatatggaaaaagcaatgatacatcatgttatcgcatattttaaaatgtgatcatgaccagggaatcttgaaagttgtcttatgtaataatgtaaatcaatgtagaataccatatatttttttcttgcaaggttattattaataggaatgactatttgtagccaatgtgttcaaatgcatgggaggacgtaaacacttcataatttcctggaaatacagacatatatcacttaaaataatacatttctaatataaatttaaattatctacgtgatatgaggaaacgagcttatttttgataattttcctagcagtgaatcaactatactcatttgaatctaaattaaattaaatttgagtaaattcagccatttctaaattcagtccatataaattcactttgggtaaaagaagacaaaattcctgaaaacagtagattaaaaaaataacattttaagagcaggtatgatctcaatgaatatagtgtggtaatttctgcctaatacctacccttttggaggaaggaaaggtaatcctgtttgtgtttaatgttaattactgaactctttataacttgttttatttatttattgtttgattttaagcatctgcttctggtggacttacatatgttgggtttgggaaatttcaacatacaggttggcattccagtggctatagttgtttcttgaaatttagtactgttttccaatgatgattctctttgggaataggctgttctcttttacttaaaaactgtaaaattagccacttcagttgagactcctccaggtttggaagtggtgaagaatatggatatattcagatcaaatcagtcattctctgtgatacagcaactgaacaagaaacccagacttcaaacaagcagacttctttgggttggactgaataaaatgagaagaaattacagaggatttgaaaatgtatatggcctaggaattattgaaattattttggagggtggcaacaaatttgggacattgtactttctgttttaatgtcaattgtataatgtgtaactctagtgagcatggctggataccgtggcttcacattttaggtagactgggtgttttatctactgagtgaattacagccttcggcaatgatgtcaaggtagcaacaaaacccaaaaaatccatcctttagaaattgttttaagtcacaatgatgataccttctttaaaagctttgacttactgaaataatgcttttcatttgtccaagatgagtacatagcagaatttggaaatatggttccaaaaggctaaatagactgacttttttgatatttttcccttatagggagaaagaaacattaacggtttatcagatgccttgactgtactttttactgctttgtcttcaaggcctagtgtaataattaacatctagtatgtgtttgatggatagccaatttttgcttcattggtatgttgttaccacagtcattggtagagtcaatatatgaatgaagaaagtataacaaatttgccctctagtagagtacaggcaaagtatggccgtcagtttcaccctgattttttttcctccattcttttttagggtttaggtcaagaacaagggcatttcattgtaccacatagctgagagtagggaattgggacatactgtcttgctttaaattaaagttgtctgtttcatcaagtagagaggttcctaagatattgccagatttctgactcggggtttgttaaaaatagaaaaggtagttccttaaggttgtattttattggatgcctccacctgcttcaggctagctcactggagaataaatattccaggttaaaaaaaaaaaagcatgtgttcacgtgaacttgtcctttgagcaaacctgttggaaatcaagaggtcattgctgttggagaggataagagggtgtacttgttggtgtgttaagagtagttcacaacataaaaataaatgtaaatgcatctattatatttgggttggcaaaatatattggttatttactctgttgattcctgtagtgtacataaatatgatctacaactctgtgaacaaaaaggcttgaaaaattgttctgaaaatggacaaatcatgaacagataattgaacaagaaaataagcagaaagtaaatttgtgaaatatttcaaactcatttacattcagaaacatctttttaagatcactgtgatacattcgactgtcaattctgaagagacgtataaaggaaatgccagctaaggagcaaggaaacagctttcattcatgggctaaattgcagcttaaaaaagatggaccaggattatttcctttagaaacttactgtacaaaagatactgttcaccccattagagaactgatttgaagttactcttccctgtgagggctctgtcatcttaactgtattcacatactttcaactgttccccttgctgctaacctcaggttctttagttcatctatctggcagagctgatttggggaaaacaagacaaaccttctcaggttttcttaataaataagcagttgtcatgtttcaagagttttagaaatgagcaataatcaaggaagaggacaacgattgcatacgtttataatatttagaacatcttttgccacaataaacactggaaaccacccacttgtggacaccaaacatttggatttgtatattttgtggcattccctcactctaatcctctcatccttaaaaattttcagaaatttttgcagcaacaaacactgattgcaacatatgatttagggtagatttatgaaccattttttcactgaaatacatcaacaggagtgagtagtctgagtgaccaccccagcatggagaaaactgtagtttacagattcttctggagcatttttatttctagattgcggtggaagtctaaccccccttggagatgtctgccttaaagggtctttggccagggtcctctgtagagccatagtccagatctactctatttgtgtgctccttacaacatcagaacagcaactctcaatccggattcatccccagaatgccgtctgagtcacagcgtggcaggtgcataaagaattatctactgaattgagaaacatttcaaatatataaaacttgaaatattttgggtagtctgtacaaactcaagttgacaagccaaccctgcaggaatatatggatagaaggggaaggataacatgttgaattcagctacatgcctcatcagctagaaaaccttggaagaaagaaagatagattgatacttgcctgaacttcatcaaccaataatattttttttcttgctatggagagtccactcgcctttggaagatttaccagtaaaagccctgcacatgatatacttgtgtgcacatgcaataaggacatcattccccaactcctgctagcattgtgaaagagctccaaatattcaaataatataaactttttttcgtggacatttagcttacgagtttgtttaaatatgtgggaaaattatgtttagataatagtattgaaatgagaatgtaagatacacattgaatgataaatgtgtatgaattgttcattgtgccttaggtaagccagacagtgaaattaaatgtgtaatagttgtatttttttgcataatcttggaatgtaattagttaaaagcaaacacttagattttgaacatgaatctgttaagcttgttaatgtagttgctgtggctaaataactggtttcctggggaagcttctatttgctagaattttattctggaacagttgttagaaaggaattctcaggtcaccttttaaagatatacacaattctgtattcactttttgagtgcataagggtaatagaaaatgacatgggaagcgttaattagaaaaaaaggcattttgtttatgtgcatttgaggatacagtgtttgaagtttctaaataattgttttatgacattttcttggtacatagatattgctaacaattagtttgctgaagtatgtagaaacattttaagaaatgattttagaaatataattgttaaagtacctctgatgtatattaaaaatccttttattttggtttatattgctatggatgtttttctgggggaacttaatgtatacaacttctaactaagaagttttattaatgctgctttatgtatgaaagtcatggatgtggatgttattttgtcagtggtctttctgttaaaatttacgtggtgtaagattttcttttcatgatggaattgccaaaaaggccagcctctagaacacttacatgttaagggttgggtgggatttgtattactttgtgtatataaccgacaggattgtgttactgaatcttaaccagcatagagatggctgacattttgcattttgggggacattaaattgttacacaatgatgtcattggttactgataggagtgtttagactcttagatggctttgttagtattaggcaaatattagatgtggatttaggagataagagggtggggtgttggagccctgtgtgcacatgagcatatgttgcagggcctccagacctaaatccacgtgaagatggtggtggtggtcttacctatatgttaacattacattgtaaacaggtagactactttccttttgctagtgggagtgttaaatcacctctcagaacattaattcattaaattgcccctaaacattaattgattgctggtggatatgctaaatatttttaacatctatttttctaaatgtatagatgtcatttttaattcataggggatagaaccagttttgcttgcaaaaagcaaactgttcactggatcattgggcttaatttttaggttgtggtagatataatagaaatgttcttacaatttgtagtataatactgtatatctctataaatatatatgtgactgtttttctgatagatgcaacatggtggaaatgtcatcataaatgtcggtctgcctttgtttatagttttcagatgtgtatatgcagttttttatacaacagaaaaattgccacatgagtcaaatagcataggttagaaaagttctcatttgccaaaaatatgtgactttcataatagtgagttgtttttgatttaaaatgtttctatctgtagaggcattttataagtttttatggggatactagcaatgggatgtgaaacctgagttcattagatcattgggtgataatggaacccttatgtgtatacaatatacatggttatatgttttttaaagcataggagctattatgtctgcatggttctaaatatatatacacacacgtaaacacatatctatatatctatctatatagatagatagataaatacatacatatgtagtgaaagcttttgtttcctccctcacataggcagattatttgtgtgtgtaaatgagcagctgaaggggaattttgttacatgtgtataagacagtcacaatatataattgttttgctttaattgtttagtctttgatttgtaggaattgccaacacgtatatttgtgtgtatgcaggtttatatataaatacatatcactgtataaacaacatttattgtcataggatagaaatattcttaagttgccagagatactgtatggctgctaaatgtatagtagaaaaatgttaccttttgctttttagcatctgcatacagattactaataggcgtatattgtgaccagtaaaccactagacaagggcataaacactttagtttgatcagtagaattgctatgccatgtttaaatgggatttatttggttgatgcagaatatataattgtatctagaagataaatattacaaaaatattttaatatacaatttctgtcatatttttggaaatatatttttattcaaaagtagaatcattgttgccaatagagttagcatctttgtgtgcttgtgaggtttgattttgagggttttcttggttttgttttgggttctggagttctaaaaaatgagattgtctttgtctaaacaatttttatataaaaatgtacatttttgtattattttttcttattccaacctaatcggtggcttgtcccttcctgtgtttattgggctgttgggtgcctggatagagctggagaccatttaactgctgtatgaataatagataagcgtcttgaataacatctgaatttcctaggtatgtagaaacacccaccatgcacatatatgaacatacagaatatatgaatgttaaaatatggtgaaaacaatcttttgctaatagaagtgttaacctttatttttaaaaaaaatttggtgtgtatgtagaggtttatttgattgttagttgtgtccatgtataatatgtcatctacctttacagatgtgcagaaatttgttgtatttggtggatatattttacttaaaactatagggcagaagctttttatgtttgttgaagtgaaatggcataccaaacctgtgtggtagagtgggatttttagattgctgtgtgtacagtcaggttatatctttaaaatacctattcgttatatattaatatgtagacattgctgatacatatgtatgtaaaaatcagagtatttttattaatataggcattagcttcttgattcacttgtttgttgggaagcacttggagaaggatgttgaatactttgtcatttcatctctgtgacgtacagttgtcatgtcaaccctcctatctgcgggttttgcatctgcaagcacatgcagctggaaagtacagcattggcagaatctgaaacccgagtaaagagcacctcattttcataaccatgggttctgaagagctaagggagttgaggatgcaccgattttggtatgggggtacggtacaggtacaaatccccgatggatatcactagacaactgtacaatcctctttagctttttttttgttttatagacagtgtggacgtgcatatattgcaagcatcactttgttaaactatgcttaaccctgcaaatgattttaagagctctgtgtgggtggctttcttgggtttactattaaatatctgtgtttatcatagttgttctataacatttcaactttgtaaatatgtagtttgttgataaagaggatagagacatttttcttttgttgatagattgttctttcccctttgcttagtcttcattgtgttgctgggattgtaaaagacaaattacttgcacatatttaagcttatatattaaatgtatatatgctgtcatgttagagagggagagtggttccctcccccacattttgatttaaaagtaaaaattaatttttattaaattgtttgggtcagtttcatgtaagaataatctctacattgaatggtatatcttggccgggtgcggaggctcacgcctgtaatcccagcactttgggaggccgaaggggccagatcacgaggtcaggagttcgaaaccagcctggccaatatggtgaaaccccgtctctactaaaaatacaaaaactagccggccgtggtagtgcacatctgtaatcccagctactcggcagtctgaggcagaagaatagcttgaacccaggaggcagaagttgcagtgagccaagatcgcgccactgcactccagcctgggcgacagagtgagactccctctcaaaaaaaaaaaggtatatcttattttctttgatgtactgaggttcatgatgcaattcattcttaagcatatactatagaatctttaaattatatggttctgtgttcatttgtggcatgacagtaaccaagacaatttagtaaataatcagcaaatgaaatatttaattttgaacatctagtatttctagatgtatagagagtctcacgaagtagattttttaagtatcttgttgtaaatttgttagtactgttgtcttttgcaattaatgtggcaatgaaattgattattgatacacaggctcttggagctaaacaaaatttatcgtgttttaatttggatattagaaggaggaaatgaaaagagactctctacattttacctgttattatatagcttaccattatatcagatatgaattgctttttttaaaaaacttagattaaatgtcatgtaaatgcatttagtctttccagatacacttcttgatatcataatttttatttcctgttaatattcaagatataaatgacttcattaaagagattttctactacctctaggaactatacaatattctgtatgtgttcccttggttgcatgacaatattcaagacaactttgtaaataatagataaaaaattttaatttttaacatctagtctttctagatgtatagagtctcacaaagtataattttgtaaataagtcattgtaaaatttcatggtttcattgtgttttgcaaatgtcttggcaaagaacttgataaaattttgggcttcttgacctatacatattttggtatctctttattgggttgtttagtgtaaggaaaaagttgaaagaatgtattttcaactttgaattgtaatcagaaagaaaatatattttaaccattgtttagtgcttctgttatatattgaaaacttcagtcttaattttttagttacattgttgatagggcattatataaatatacttctatagtcattgtaggaaatgtcttttataaggaaatatttcttctacctctgaattacacagttttgtatttacttggactgcatggcaacattcaaaaaacactttgaataacagataaaaatgacattttctaaagctctaggtttgctagatgcatgaagtctcagcaaagtataaatttgtaaatatttcattgtaaaatatcataaattgactccttcaagtgttcagtagtacaataggtaatcaataattggcctcttgggactgactgtaacgttttggtgtttgtatgttttgagacagagcaatagattgcctccatatcttttaaacattcaggtctcttgtataagaaaaataaccattgtggggtttttgtgcatcttatactaatatgaaacaaacaaaaccccctggatattttatccttagaaagatagaggaagacaggagaagggaatggtcattgtaaattagatagatatattgagtgttagaagattatttaaataattgttcttttgttatttgtactctttgcaaatttatttaaatgcatattcatgtatatcataagtatatattcacatgcatgtctaaatttagtggcatagatctatctcaggggtattaatctttcattcgtgtactgatttgtgttttattttcatttaaaaaattgtggaaccagtggctgggcatggtggctcatgcctgtaatcccagcactttgggaggctgaggcgggtggatcacctgagggtcaggagttcgagaccagcctggccaacatggtgaacccccccgtctctactaaaactacaaaaattagctgggcatggtggtagatgcctgtaatcccagctactcgggaggctgagacaggagaattgcttgaaccctggaggtggaggttgcagtgagccgagattgcaccattgcactccaccctaggcaacaagagcaaaactctgtataaaaaaaaaaattaaaaaaattgtggaactagtgttttatttctaagcttgcagatatttctagaattccacttactgttacatctaaatgtatgctgatttttcgttaaataataagcaggtctgtaaacattttcttttctaacctctttccatatttatatgagtatagaaaaactgtggttatgaatattttttactttttgataacttttaaaaactatcagatatgtgataatcagatagatttcaagtttacttacggtgtaaattaggaaaatttttataaagattctatccagtattgatcaaaagtataaattgtgtgtctttttaagcagcagtttggcaatgacaatcaaattgatactatgtaaaagttttgaaatgttatagctggctactggggtttttatctattccagttctcgaaaatttaccaaatataggttggctgtaaaatcataactatctgaggtatctgtcaataaatcaaagattgcaatgatgatagcttctttaacatgaatgtaattctaacagtaaaaaatttctatatggaatatgttttgtagtcctaaattgatattttatatcatttttcagtgaacaagtagttgtttacaggtgtctgtgcatatgtctcaagtttttctaactaaaatattaatagttaagtctaaaaatatgaattatacgtggggcttgtcattctgacatttaatacttcagcgtggtgataatggtgatataatatactgtttgaaattgtaacacatgagttaaaatcaaaagattgataagtacatatttgtatattgctacatgacaaaaatctaggaagaatatgattcacatgaaaattctttggaaggacatgacagacttttaacagtcctgtatagtgaaaggagaatagaacgactacttctactttctgtatctgaaattttcaaaagctatttcaaaatgaacatttaaacaacaggaaattttagagacaaccactttgtgcctgtcttcatccttgacattcaacatcctaggaacaatgggctgttgtattcaacttcttattcccaacagccattatgaatggtttttgattgatctcacaaagagcatgtgctttagacattaatgcagcgactaccatgaaacagagtattggattacctaaggaaagaagcagaggatggaatttgaggtaggtgtcaaacagtgaaatttcgtttgagaaacagatgagtgaaagaaaatagtaactgaaacattcattctataaggagagtacattttaatactggcgatgctgtatttgtgggtactgactagatcaagatgttagaggaggtgtctcttgggataagttggaagttatccttcattaatttggtataaactgaaaacagattgcttctttccttttaaagtggttgagtctctgatgggtttaaagtaggcctttggggatttatagatcattcaaaattagcaggggaaattttaaatattctctgcatctttctaaaaggtgtggtttaaagttggtgagaaagtgaaatggttgctggttgaacttgattttctctattcactatgcctggctagcctaaaattatcctaatgggtatgttcaggtgcctgatttgtatctaaatgtttctgtattggatactgtttttcttaggcaatcaggatgagtgaaaaattgatttgcagctgacctgcaaatggaatcatcaggaacatccctttctcatggagtcccttaatttacaagttaactgcaaacataggtaagaaggttctggtgctatttgggggtgaggtattggtgaggttttgcctaagctcaggaaaataatactggtacaggtgtatttcttggccaccttggaattatcaaatgagttagtctttaaaatatattttatcgaagtgaaggtatagtttggttcccagaccaaactgagggtcgggctgctatttctcgtgccccaataatgagatgcagatgaacaggggaggaagagttagagctagttacaggaagaaggcctggaaattgtcaccacaccaactcaaaattacaaagtttttcagaacttatataccttctaagctatatgtgtacatgtaagtgtgtatctaaagacataagtgatctataactaaggtctgagtcttcgagaccttcctttggagcctcagtaaatttacattaatttaaatgggtctgggtgctgaggtgattaccattatcttgtttcctactaaatcatggaggtttggggagttcctttagaacccccaataaacttgtttgtggaggcctggagagtttcttcagacccctaataaaacttgtttaatcgtgctttaaggttcaagagaggcctaggtaaaacttggtgggcttttgtgacattccaacctttgtataacaaaatggctctttcagcttttagtatttaacttaaccactccgtcaatactgaaacagttgttatggaggcctccattagagggacctggcctgccacaggtgcgcgcgcacacacagatgagagtacctttaattagtttacttatctatggtcaaacacgacaatataactaataaaagaaatgaccaggcatctaattactagaaattataaaattgacaatatgtgtgttttcataaatgtacagttttcacaaaatgttttcacatacagttctttgataaagggtgaagttcatggaaaccacagaaagatgctgatactgtaaactattaaagtcattactgaggttgtaagttgactttgctataggattgataatgggaagtgtttctaaatgttaacataacctgtaataaagttcaacatgagcattcacttaacctgccgccttagctgtttcattagagtggtatatatctcaccttacagtgtttcttctttttccttgtcaggagatgatagttccaagaaggaacattttatcgtctttgtttttaatctcaagaatggtacctaccatcagtgaatgacctgttgcagtgctttcattgaagtgttcttcgttccctcagcaatatgattgtaagggcagttgagtgctaacttgactgggagaggggcggtttggttagacaggacttgatatattctgtttttcataagcttgatgtttttttctggcagctacttgacattcagatctgattggttacatattgctatgtaataaattatcctgaaacaggggcataaacaatattgttatgtccatggattctgttggtctgaccatgcccaggacagtttaggaattgtatcctctccaaagtttcattgtagcttctgtgtttttagtatagttactatttctttctcatcaaatagactgaactccttttgttattatcatttaaatatttaggcattgttgtcatgtatattgtgcataaatgcatgtatactgcaggtaataattctgtatgtgaacaagtgacctagaggtaaaggaatccaaatacagagacgtgtggataatgtgggagaggtcagtttttcacaagacataggaaagaggctgggcgcggtggctcctgcctgtaatcccagcacgaggccgaggtgggtgtgtcggtcacttgaggtcaagagttcaagaacagcctgaccaacatggtgaaaccccgtctctactaagaatacaaaattagctgggtgtggtagtgtaatcccagctacttgggaggctgaggcaggagaatcgcttgaacccgggaggtgaagattgcagtgagccaagatcacaccattgcactccagcctgggcaacaagagtgaaactccatctcaagaaaaacaaacaacaacaacaacaaaaaagaaggaaagagctaacatctgacctcctttattattagaatactccaaaaggaattttgatccacatgctctttcttcataatagaatgaatgttgcatgtcattttacagacaaattttattagttcttgctgatgatataaactttgcttctaaccttttcccattttcccaactgtgtctctcaggtgatgactgaaaaagggaaactgtgccactatttgtaccatcattttcaccaaaatctaaaaatgctttttatgacgtatggagacattcttcatgtttgtttcagtggacactccttgcagatgtaaaaaactgagaaaactcacttttggaaagtgacctaaagagtgtcattgaagtgaattttaagtaggcacgatgattgttttcatggttgctgttggatcatatctcaggagctggaatgacagacattattgaacaaagaaatcaggatagtggaacttaaagggcttcatctcagtgctttcataagtatgaagtgcatatatttataattttcactaatcacagggtaaatataaaattgattcattaaaaatgtttcataagaattcaaaggacatagaattttgtgaaatgtagtatttttacttaagtgccttttctctgcttctaccccacagccaattttttataaaccagttgataacataagtagtttttgggggatgatacattacttatacattttctatgtagtaaacatgtatgtgtatgtgtgtgggtgtgtgtctaattactttgttggacagattcctgtggtttggaactgctggggccaagtttatacaaaaatctacatttttgagtaaactccccatgactctagtaagtttccacagtatttgagtattctttatttcctaaagctgtacaaacatcagataatcaatatttgtaaggatcgataatataatttataatgaaattgctttatcagctattaatgttaactacatcatcttcatatagccttataactcatttgtgctattccattttcctctgttccttttattttcacttcccttgtaatgttagtctctttgtactgatttctgaagagttcatttatgattaaacatgttaacattttgtctagaattgcaaatatgttttttctcattcattttactatggtgttttattttttggttatacagaagttgtatattgaaatataatcttgttctgttttatgactttggagttttgtggttttttaaaacatgtttacattggtatcatttatttgtattgccttctatttcagcagttagtttgtcatttctttttccattaatcatcattctggtgttaatgaatgcattaaatatttaaagtactcactttgacccgtgtagttatctgttaagttctaccataaagaaaatttccaggtaaaattggctacatttctgttaacttgccttaccattttattgacactttaataattactaatgatttatactgtcttatctattccattgagttctatctcatttctcttctttttcagaatattccctctgtatacttgcatttttttctatcaattgacgcttacaattatttttgcaagttggaaaaaaatgcagtattaatttcatttgcaacaaatttaatagattaattaggagagaatagatatctttaaaattgagtcttctgtccaactgcaaggtaggtctttctatttttaatggaataataatttggggatattgctagtgcagttttttaaagtattttttaatactaggcattttttagttatttgttaatttagtgatttggattagtcattcaacttgtctaattggtatgtgaaaactttttgtatgtcttttctagtaatctttactgaatttctaaaattatgactttcttgaacaatctgtcattttaattaccttgattaaagtacatttgtaagtacttctaggatatatggaagtagaaagtatacttggcaattggactgttaattgcaatccccttaggtcatggttgtttttgttcttattggtattttagtaatcttttagaagaaagatgttttaccaaatttggtgacaggtttaataaaatttctttttgtatagttgaaaaacttgtccttataattattaaggttaaaattaacatattccaaaattgaacattattccatcccatgaatgaagtaaattatattttagtatatactccttaattatagttgttataatttcatttggaatttctgaaatgattcctaaacaaacagctttatacttgttctgttatcagaggtttttaatgttttactggctctttgaaaccattttgagtatttctgacacagactagaaacaagtaatatttttctttaattattttgaaatgttggcttaaaaaggtgttgaaataatagcgtgtttttttttttaaagttatttatcttttgtccaaaatcaactaagcatttatgcaagcatgtgttttttggaacccttttttctgtttccttgttctttgtgtttttctttatgccaatatcacactgttttgataattgtagctttgtagttaacattttgaaattgagaactgtgactcttccacctttgttctttttcaggtttattttgctcatttcagtcctttgaaactctgtatgagttttaggattttttttttaatttttgcaaaaaatgtcatgggaagtttactagggattgagtctgcacattgcatgagtattattgacataaacaatactaactcttccagtccatgaacatgggatgtctttttatttatgtcatttatttctttcagaaatggtttgtaaatttcattgtacaaaaaattttctttgatcttactggttaagttactttctaagtattgtatttttaaaatgctattgcaagtggaattgttctttgaacttcttttgtgaattgttcattgctatttttgcatgctgaatttgtagcctggtattttgtggaatttatcagttctgagatttttttttatgctcccaaggaaaattttagcccgtaataatttttttggagacatagtctcactgttgcccaggctggagtgcaatggcactatctcccaggtttgaacaattctcctgcctcagcctcctgagtaggtgggattacacgtgtctgccaccacgcctggctaatttttgtgtttttagtagagatggggtttcatcgtgttggccaggctggtctcgaactcctgagctcaagtgatcctcctcccttggcctccaaaagtgctgcaattacaggtgtgagtcactgtgcccgaccagcctataaaattttagtggatgccaagagagatacttctacttcttttctgacttgggtgtcatttctttctttttgttacttgattgctgtggcaaggatttgtaatactgtgttgaaaagaagtggcgaaagcaggcatccttgcttttgtaactgatactagaggaaatccttttagtgtttaacctttgagaataatgtttgttttgagtttttcatttatagcttttactatggtgatgtgatttcatctattcctaatttgatgaatgttgaattttttattccttagtctttgtcttgctttggtaagagggtaatgctggccccataaaatgtgttggggagtgtttcctccttgaatttcttagaaaagtttgaaaacacttgttatttgttatataagtatttatttgatggaagattttttttttttttttttttgagactgagtcacgctctgtcgccccaggctggagtgcagtggcgcgatctctgctcactgcaagctccacctcccgggttcacgccattctcctgcctcagcctcccaagtagctgggactacaggtgcccgccaccacacccggctaattttgtgtatattaagtagagatggggtttcaccatgttaggcaggatggtctcgatctcctgaccttgtgattcgcccgcctcagcctcccagagtgctgggtttacaggtgtgagccactgcgcctgaccggaagatttttcattaataattcagtactgttaatagtttcatgcgtgtggttttgttttggtggcctttagtttcctaggtttgtaggaatttgtacatttcatctagattatctaattttttaacattcacttgcttatagtactcttacaatctcttagttctgtagactttatgtttctgatggtagcaatttgagtctgccctctttttttctagtccacttagctgaagctttgtcagttttcttgatttttgtttatgaagaaccaagtggttattttgtgttcattttctgttttattcatctctatatcattctttatgtccttccttttcctctttgtgtttactttgcttgtgtaattctttaatttgtacagttggttgatttgaaattttttttcatgttacattaataggtgtaagattcataagaaaacatgttttattttcattttcattcattcccacatattttctaattttccttataacctcttggtgtactagttgtttgtgttttctcatgtccacaaatgtgtgacttttccaaggctttccttctgttactgatttctaaattcattgtcttgctgtggtcagagaagaggcttctttttctgtctgttttttcaaaatttattgagactgaatttgtgaattaactacatttgttgtgaaaaatatctcatgcacttgaaggggagtgtgcattttgttgttcagagattgttgtgtgcatatctgttagatataattgatttattgtgatattacacacttctattttctctttttttgtggggtgaggggtgagacagagtctggctctatcccccaggctggagtgcagtggtgtgatctcggctcactgcaacctctgcctcccagattcaggcgagtctcctgcctcagcctcccaagtggctgggattacaggtgcctgccaccacacctggttaatttttgtatttttggtagagacagggttttgccatgttggccagggtggtctcaaactcctgaccttgtgatccacctgcctcggcctcccaaagtgctgggattacaggcgtgagccaccacacctggcccacacctctattttcttgttttctggttattctacccatcattgagagtaggttcttgaagtctatatttcttagtgaggaaatgtctatttctcccttcttttatgtcaatttttgtttcatatattttgatggtttactaggatcataaatgttggtcatctttatcttgtaatttttattaatgtataatgtacatttttgtttgttgtaacattttggattaaaagtctgttttgtctgacttaagcagtctacaaaataactgcttctgtaacaccttctctcctacccctttcagttgatgctacaaaattatatgtttaacattgtgtatcaaaatatatatatatatttgagatggagtcttgctctgtcacccaggctggagtgcagtggcgtgatctgggctcactgcaagatccgcctccagggttcatgccattctccttccttagcctcccgagtagctgggactacaggtgctcgccaccacgcctggctaatttttttgtatttttagtagagacggggtttcaccatgttagccaggatgatcttgatctcctgaccttgtgatccgcccgcctcggcctcccaaagtgctgggattacaggcttgagccaccacacccggcccaaaatatattttgtaaaatttattttttgttaaattttttagaagataacttgtagagttataatcaaagttacaataatatttactggttttttgcctaatgtgtggttttataattgatcaattcaagtcatgtagaatctaaaaaaggcaacaggctgggcatagtagctcatgcctgtaatacccagcactttgggaggctaaggaaggaggattgcttgagaccaggagtttgagaccagcctgtgcaacatagcaagaggctgtctctacaaaacaaattttaacaacaaaaaatagctgggtatggtggcatattcctgtagtcccagatactcaggaagctgagatgcaagggtctcttgatccctgaaggttgaggctacggtgagccatgatgatgccactgcattttagcctgtgcaacagaatcagagcctgtttcataatgaaaaacaagtggagggacagtacaccattattaacctctcataattgctcaattatttacctttaaccacatctttatttctttatagggcttccatttactatttatttcaaccttcaggagtcttttcagtgtttctgtttggtgggggagcagatctaatgtaaacaaactcctgttgtttgtacatctgggaacgtatcaatttctcccttactttttaattaacagttttgttggatattagattcttagttgagtatttttttttttttagcacattgaatgtgtcagtccactaccttctggccttatgagaaattgactgataatccctgttacatgatatcgtttttctattgttgctttcagaattctttctcttttgctcttcatagttgaaagatattgtgtctcattgtgggtctttgagttcatcttgcttggagtttgttgaggttcttagatgttagaattcatgtctttcatcaaatttgagaagtttccatctagaatttcttcagatattctttctattgcatgctttctcttttctgggaatcctgcatcgtttgtattggttagcttgggtggtggaccagaagctgtttagactcttacctttcttcaatattttttctttttgttcctcagaattgataaaattctgaagtttgctgatcttttttgttgcctgctgagataatgcatttgaatccctgtagaaaatttttcatttcagttaattgaatgtttcatgttccagaatttcatttggggttcctttttgaaagtttttttatttttgattattgatccttccattttgctcatgcatcattttcttaaccttctctatcacttcctttagttctttgagcaactttaagacagttgttttaaaagctgcttacctgtcttaccatctttgagatcagaagtggtaaactgatgagagcacagcctctcaatgtttgtataacagagtggtgtgttttgttttttgtttatgcctaccatcactccttctgcaagctgtatgtaagttgtccaagaaatgtgtacagctaccttgcgtgagggtgtaggagttagggataggtaatttgtactttgctaagagttgatgttgagtgaaattaacctcaataaatctgaatttagggttaatacaatcctccagagttccaaaccagttatatcataccgattattctggtgtatttatcatctcagggggagaaagagttctgttgcgtcctgctctgccatactcccagaatcctcagctcaccagttttttagtttgtttgttttgtttttgtatggatacagtttctcattctgtctcccaggctgtagtgcagtggcactatcatagctcactgcagcctcgacttgttgggcccaagggaccctcttgcctcagccttctgagtagctgggactatggacatgcccgaataatgtttcttttttaaagagatggggtcttactacattgcatagcctcatctcggagttctgcactcaagcattcccccagtctcagcctcacaacgtcctgggattctaggcgtgagtcactgtgcccagcttgttttacagtagtgaaatgaatctgcccatttatactttctgattatcaatgaaagttgtgttctataattttgttgcttttcagttgtgatagtttatgcatcacataaaatttgccatattaaccagatttaattgtactactcattagcattaaatgcactcacagtgttgtgtaactaacaccatattcaaaacttttgtcatcttaattggaaactctatacctgttactctaatccctagtcccttgtctccccaatcatgttttctgcatttgattttgcctattgtaggtatttcttacaagttgaatcacatagcatgtgttttttggttcctggcctattttacctaatgctttcaagtttcatgtaatacatgagaacttcatttcttattatgaccgagtaaatccattttgtgtatgtatacatgtgtgtatacatgagtgtgtgtgtatacacatataacacaatttttatccatctgctaatggatagaattttaaatctattcctctgctaatggacattttatatgccagtgctcaccaaaacattcacagtgtccattaagagatgaatacatttaaaaatatgtccattaatatttgagtgagcattggcatacaaatatctgagttcatgtcttcgtatctgattatgtatataggggaatgaaattgctgagttatgtggtaatttaatgaactcactttttgaggaaatatttgttatttattatgagaaattgaagtcaccaaaaatgagaactgaataatgaaccttctcatatctagcaactagagttaataactatgaacattttgccatattttgaaaattacagttaccatggtgatttaatcctgaataggtttatatttttatgtatcaatttttaaaataatcacaatatcctatctctacctagtaaaatttactaaaatcccttatgtgtcttctaaacacacaaagaaaaaacaattctcatttaaatttctcaaggttgtgcatggtgtctcaagcctgcaatcatagcatttttggaggccaaggcattttgcttgagcccaggagttccagatgagcgtaggcaaatagtgaaacctgttttcacaggaaaaaaaaaaaatgaggtatggtggcatgcacttgtgaacccaattatttcagaagctgaagcaggaggatcacttaagcagtaggctacaatcacaacactgaactccaggctgggtaacagagtgaaacattggctcaaaaatataaaaaattctcagttgtgcgaatgatacaacagttttttgagcaaatctggatccaagtgagtaattcacttttatctaggctatttttatgttagtcttgactgtattaatttatattcaatcttaaatctctcttaattaaggtatgaaagtcaacccttttttggttctatatttaagtaatttttaaaaaaatcttgaattaaaaacattatttagaagtaactttcatattctactggatttcttatttgctggtttttttggggggattgattctaccctttatttttagtattctgaatgagttttggtgagctactgtggtccaaaatatatattgtgtatacacaatacatagtctgaattcttgtataacaaaagtacagtccatatttgtaaggggtgcttggaaaggtatattaggtatattaccttacatgtgtagatcttcataagtaatagttggcaaggtctgctataaacttgttacatatttctatatttgtcattatattagagacatttttagtctttgatgttatttttcccattaatatggtgtcctgacctggtcatgctttcagtttttcatgagatcatgctaatgaaatttcttaaaagttttgcaaatataatctgataacgtactttgattttttgaaaaaaagtcatctcttacccagtaaatatcaactaattgctggttttcttttgtgatttcttctcaatgtattttatattaaggtttggagataccagtccttttaagcctaatcctcatgctatctggtaaaaattattaacaactaaaaattacttaatgtatattacaaaggaggtagtaccatctatgaaatctttttgataaatcttactccactctgtcttatgtatgtttaaatgagcaccagaagaattatgcattacatttcatttgattggttaatctttgagctcttggtttttaatatttgtttcttgctgttttctctttgaggaaatgagttatttgcgatataaaactttcacatttctacattgtgcccatagtaggatgccacccctgtggtcatgtttaatagttttttctcagtgtttcggtgtttaatattttctatcatttttttaaaaaaatattcaacattgagacatttttctcaatgtattatattctcaagatctgattttttgtctgactagttttatcaaatcattaattcagccatttattatatgaacaccttttgtaaaacagaagaacactaatttatcatgatattttcatatatattttgtgatattgagaatcattaagtattttatcacctgctttttacaaaaacacaatagtctctcatttcactaatagttatacatttgctctaagtatcagtaaatttactctgaatgataagttcttcatttaaataggaacttaatcaacttttttgggatttcagttcaaaaggaaaggtaaataaatgttttttcccttatcttaccatttatataataatgaattgatgtgcaagtaatcttcaaaggtgactagtttttaaattcatgttctttattcagaagacagaaagcattttcaggagatttgaatatttgaagttatattttaaaggtgataatgctaatagcataattaaaaaacagtttctgcatgtaaacacatggtagaatataacaggtaatatatatttgtaattatttttctatttcatgtttattcaaatgtatgtacaatctctgtagcttgtagtttggctgtgttatgctttataaaatttatttatctgagacagggtctcactctgtcgcccaggctggagtgcagaggcatgatgtcagctcacagcctccacctcccaggttcaagtgattctcctgcctcagcctcccaagtagctgggactacaggcgtgcaccaccacatctgactaatgtctatgtatatattttttagtagggtcaggttttcaccatgttggccaggctggtcttgaactactgagctcaagtgattaacctgccttggcctctcatactactggaattataggcatgagcctccacacccggacataacatttattttttattttatattttatattttatattttattttatttttgagatggagttttgctcttgttgcacaggctggagtgcaatggcacgatctcgcatcaccacaacctccagctcccggttgcaagcgattctcctgcccagcctcccaagcagctgggattacagataagtgccaccacgcccggctaatttttttatttttagtagagtcagagtttcgtatgttggtcaggctagtctcaaactcctgacctcaggtgatttgcccgcctcagcctcccaaagtgttaggattacaggcatgagctaccacgcccggcccataaaatttatttttatcccagttgtgtgtacttatttacttatgtatttatttatatttatttatttgagatggagtctgactctcttccccagactggaatgcagtggcacaatcttggctcactgtagcctctgacaccagggttcaagccatcatcccacctcagcctcccaagtagctgggattttaagcatgtaccaccatgcccagctaatttttatattcttagtagagacagggtttcaccatgttggccaggctggtcttgaactcctgacctcaggtgatccacctgcctcggcttcccaaagtgctagaattagagaggtgtgagcctccataaggaatatgatttgaagggaagaggggatatgagtgtgaggtaaatgttttcctatttaaatattgaaatataaaaggctattcagtttccattcaagtaacatttggaagctttttatttcataatactattttgtgtagaaaccattactgtttgttttgtatttgtgtaggtaaaaagtattatgaaattatgtaattacagtattcactctgccaaaaaaaacaaaaataattataactcgggtatctaatgattgaacatttagtaattcttccctgacaaaaagagaaaaatattataactcaggtatctaatgattgaacatttagtaattcttccctgattataaaagtagcacatttatactttggaaaataaaacagcatgtatgggaaaaagtaataaacatagagaaattccatcacctcccttcccctctcctccaagaaaaagtggcttacgcctgtaatccaagttcttagggagccagaggcaggaggatagcttgagcccaggagtttgggacttgcctgggcaatatagcgagaccctgtttccccaccccacccccccaaaaaaagaaaaacgtaattccatattttacaggtttagtgttgacttcataaaagatggaagggaaggttatcagagtatcccattgtagtgattatagtgctcagattctagctccatacctgttagaacacattcgcaattgtcagcttaaactatatttgtatgtattgtttgtctgttttgtattaaaggcaaaagctcattatcaattagttgtatgttttaaagagttggccacaacatccatcataagacctatctaaagaggaatacatgatgtcttagtacaaaggagtagagatacaatgaatgtatttattttcatgtttcttaagagggaatgcactagcaattgacggtaaaatagatacaaatcaagtaaagaaaccagtatatttttagtcattatgtcgctttgaacaacaatttgtttaatcattttgcggtaactggttgcttggaactgccttattttttgtattcaatatatttatttatgggagtgtatacatattccagggtgttctagttcctcagggaaaatctggatgacatagaagaattttgttctttattatgagtcaatttataatttcatctttttttaaaaggcatttttcctacagctagacgttttgattgtcacttttgttgtgagaaaaaaattacaaagacgttgtaaagattgggaatgaggaaggtgacttgatcgggtatcacagacttacaaaatcttgtatgtaattagagttatgttaatggcacatttataagcaaagtaatgtcatggaatggaagacccataagttgacatgagaaacagaaagtgtattaaagttaatctgcattcatgggggcagattgttagccaaatgaataaagaattagattcatcttcatggtatgtagcatgaagaatttaaaatgaatcagaggtttaaattaactgcagaaattatagagtttcagaaaacgaatttctctccaattttgaggaaattactgatgatacacattgtagaagcaacaagaaacacaaagattgatagtaaaaatgaaattacagagttgaaaaagttgtgacatcacataagaagagtgaaacccttggtgtgtaagatataatcggggaaaaataccagttcaaaggaaaagtgacttgagcacatagttcactgaaaaaaatacacaaagtgctgttaatcatataaaaggattcttgggtttgctcataataaggataatgacaattgaaaatacaactaagatataattagtttctctactattagactagcaaaagtccagaagtttgacaacatttttttttttttggcaacatgttcggaattatggaaaatcatacgttgcttctgggcatgtaaaatgtaaaccatatgggtaggaatttaatattttgtaaatttatatctgtggcaaatacatagttcatctcctagtaatatgtagcagtaagaaggattgatggatgtttgtataccactatgtgataatgtcttggatataatgtagaaataggggagaagtcggctacaggaagtaaaaatggcaatatggtgctcagggtgcattcatcactataacagataaccattttgttaatggtgccctgcgcggtaactgaaattgtactgggctttcaacagaattttgtcaaaatgggacgctgcatgagctaataagttgtgaaataaatagggttttattgtggagtaataagtaacacaaagaagggggtttgcagtatcttaggaagaagaacagacgttcttggtaaagttcctttaatatgaaaatagcatttttaaatacttggagtagtgagtgaagaagctttctctatgagagcacggttagttcccaaataaatcccagcctcctctcttctgttaatttcttcggaaggatttgaggtagcttttgaagtatttggtcaaagttgcaaactcctcgggaggaggccaggcatggtacctcacgcctgtaatcccagcattttgggaggctgaggcgggaggatcacctgaggtcaggaggtcaagaccagcctggtcaacatggcgaaaccctgtctctattaaaaatataaaaatgagctgagtatggtgatgcacgcctgtaatcctagctacttgggaggcttgaggcaggagaatcacttgaacccagaaggcagaggttgccgtgagatgagattgtgccactgcactccagcctgtgtgacaaaacaagactcctcctggaaaaaaaaaaaaaaaaaaaaggaaacctgagattctgcttaacaattgtaaagtcagaaggtatgaagagtatttgaagttagacctgtggacaggctgattggatcttcagcagtatgagaaagtttagttaagccaaggtactatgtaaaactccaagctgtacagagctctgcctggccagctggtcagcacttgggtaatgaggaattgataaatggcaaattgcttcattgaatgattggattaatagtagcatgaatggataaattaacgggaatgggtatataaatgggtatgagatcaggaatattaatggagtcacaagtagatgatgcgtaaatgggactatatgtgtggattgatggatggatggaccctgaaatgcatttttgatggaattagggaacaagaataaatataataggaagtgtggtatgcatgtaagcatgtttgtgtgtgtatgtgtatataggttgatgcaagagtggaagggtagtaaggacaaaaactttggacagctatattgacaatgcaaaataaaaacatgaatgtatgaatgtatgaatttgacggatatgtgcttgaaagaatgaagtcagtttaggaaaggataattaacaaatctcagtaatgattgtaatcatgtgattctcacagtaactgttcaacagtgactgttaaggatgctgcgtgctcatggcagtaactcatgggcagatgtcacaaagacagtaatacctcttattgcttttatgacagcataaggttttatttttcactgtggctttgttagagttatggaaagtcatccattgcctcttaaatacgtaatggtaaattgggtaaaggaattgggtaaatcacatggttttccaaaacttcaggagatttagaagctgtattttatgttttctcaaggaaaggatgaaaaggacacgttaaacactgatagtgtctactgtaggatacctttctggtctcacaaactaggtatactttctacttaaatggaaactatccccttcacagtgggaaccaataaaaacctcacccaggtaaaaatccagcgtctcagtgatgctatctccctatcatgaggtaattcacagtaatctgtaccttaagtctcagtgtacctactgttggcccagagataggtgaaacttaaagataattgtaccttggctgcatgtagtggctcatgcctataatcccagcactttgggaagctgaggcgggcagatcacaccgtcaggagttaaagaccagcctggctaacatggtgaaaccctgtctctactaaaaatacaccacaccctggtgtggtggtgtgtgcctgtaataccagctactcagaacgctgaggcaggagaatcgcttgaacccgggaggcagaggttgcagtgagctgagatcgtgccattgcactccagtctgggcaatagggtgagactccatctcaaaaaaataataattgaaccttatttccttttgtacaatgtacaatgagcagagtcagggcaactataatacaactccaaactctaaggtgtcaaatgtgatagaaatcacttttccattgaaattttgaaatccctctggaaatacactgtgaaggctccctatactgtgctagagagtgttttactagggcctggaagatgctcactttttccttgttttccttggctgtagcttttacctctggcacactttcccaatccccttatcctacttaattatttttaaaataggcattgtggaggatgtttgttcatattttaagtcttaatcatgggcttctagtttctttggaagtaaaagtgacccattaaaaatgtaaaatgtgttatgtgcatcatgggcacaggagtttcgtggcctatatgtgattctaacttatatcttaccatggtgatcgtagaaccatgtgttgatatgtaattttcaaaagaggtgaatgcccttggcacagtaatctgtcatatttagcaaagcttccctgagagccatcataacagacccacaggaatattttcattagtaagaagtagatgtgttcagccagtaaaattttgaagtggccatgacttcaatctgagtacagagggaaagttacacacaataattcagtgattggtggataggtgcgttcaaggaggcagggttggattggtgttttcaagcttggtagtagtagtagacaggcagacatgtgagttgatggaaggatgcaagaatggttactgaaattttctttgtattatatggttaatgtggatttaataactagtcattgaaattatgtgggattggatatttaaagcccagaaagatgaatataataatcgtctaatataatttgaaatataataacggatgcatgcaaaattgggtgtattgaataatgtaagaaatagatggaaagtagaatatgagcaaatggctggatgcaagaatggagaatgcaggttttaaaaacctgttgggtgtatgtatggttatatgcacagtggaatcatttagtgaaggtgcagatggttatatgcctaggtgttatcattggatggatcaaaaatggaatgctgtatggatagatctttagattgatgagtacaaatatggctatctaaaaccttggataaatgtagggatcagggttcaggtacattggttgcataagtgatagctgcctgtttggtggctttagagtggcttaatagactgatagatgggttgattcacaaggtgatggtacaggaatttgatgactatgagaatgggctgatgcaataataaagtcatatatgtaaagttgactggaaagatggacatttgaaagccaatggtatattttcacgggcagattcattatgaaattataaaagttttgtttttgcattctcaacatgatgtgttagcaaataagcaaaaactaactgcagtgggttcacaagttagtttaattaaaatgatctttcaatattttaataatttggggactttaggaggttgaggaatgagagaacttcaccttctgtatattaactggtcgtatgtcacaattttcccatatttttcacagttatagctgaggtggtaccagtttaagaagtgagaacttcttcactgactgaaatttgcatatcaatccaaatcattgtgcttatttactatttttgtagacgtcattcttcaaaagtgctggtaagaatcagtaaccctggtgtactgtttatttttgaccagtttgatattgaatctaatttgtaatattttaaaatccaaaactatacatgaattctataaaacacaaagttgtgaatttgtggagtgattatcagttaggtgaaataaaagagataaaagggctccctaaattttgacacagttttgatatgtagtttatgcaggttttgatttaccagtcttatctactctcaccgtagtatgtaatgtcatctggactgagactataactttttatctgtatactcagtaaattttatattatttcagtaaattttattgaataaatgctctggaataaattcatcagctagagggagataagaaggaagtctggcagcctgtggaaaataaagaaaatggataggctattaaaagatgtcagagaccaaagtcattaggaattagaatttactataaatagtatgggttataatgagagtagcaggtttaattttagttccaagtgcatgatttaggatatcatcagtaagtaggtaaggtcagcagataggagttgaggaatatttcaacattgaagtggtaaaagtagggtcttaacaccctttctttcgatgagtgaatgaaaaatcttcaactattttccaacattcctgtttttcttttttttcacaagcatcttcaatagtcaaggaggacaaagacatctttcctgcaggtaaaatcattaaagactatattgtgattttgaagctgttctatttgctacgttgaggatatattagattcttatttgagttctttgaaattaaatttcttttctcatacatcctactttgtggttatgtgattattttgagtcgatattttaatcaaggactttatagttaactcttgttaataaccaacatttaatgaaatcaggcattttcttgactttagtaccacgagaagttgcacaagaagcatacagggtagcaaggagaattgatgggtggatactgggttttagtttgtggaaagatcttaatggaatacacagagtatcttattagtatttccttatattgtgtcttttaaaaaaattcttaacccctgaattggtgtataaattagaatgaagaaactacacaggaaatgctggttcaaagaataaataggtggttggttggcgtgaaaataatttggaataggagataggtattcaaatcacaaaaaaatgtgtagagaaacgaaggaaaatggcagctttatcatttgcatacagtacgtatacctggtttttgtaggttttgggttattccacatcagattgtaggagttcggttttatggagtattacttgacttgaagatgatatatttctgtcaccaggcatggctgtgtcataacctgttgtttatttccatttgcaatctcttcttctgtactctctcaggtggtgaccatgtggataataggatcatagacaaatggtggttccatctacagcatcaccgaaatgctgttgttactgcttctttctgggatcttcttgcatctttgcttctaaaggggcacaccttttatagaagtacgtccaggaatagaagtgacctgctttttcgcaagtaattgcctggaatgtttttatgtacttctctgcactctcaatacatttcatgcttccctctatttttgtatattaactcattgtatttcttaaatttatattttactttatgaatggaagtgagatttgtgtatggtaaatataattaattcaaccccatggatacgttagtcactgtccagatgatggcaagtctttctcagaagcagagggccttggtgtgccagtgattttttttccccatgtgtaagatactttttttcctcatttgaatcaggagcccacagtttttagacaagtcccaaatgaaatcttaagcatttgtgttatctggactagaccttctgtagtatcctttttgttagacctagtatatctcattgcagatcaggatctgagattgactatagttcacctctttccaagtacacaaacttggatgacatgacaactgagtgtgtaagggagagcgagacccttgcactgccatttgagcccttgtgatctcatcttgtagaacatgttgtacaatcattttattggtatcattagtgttatttggggctggaataaaaatctcagtgcaccaaagagatttcccctttatccacgttaccctggttttcctttgttttctgtttaacctaaacgggcttaatataaaatagtgcttatttggtgttttaattgtctgcttctataacataagctgcactgtccattggggaactgctcaccatattgcccaacctgtcttgataggtttatacatgggaggcattcagtaatattaattacctctctagaccagtgttagcaataacaaacacttgctagaattttaagactatataatcaatcactttgatgtcagttaatcctaccaacacaagattaaaggtttaaaaatctcatacgtgtacagccattagtgtctcctttcatactatattattttgttcattggcagctagatttttaggtagaacttgtgttcctttttgcaatgctcatttattttacctggacagaaggtgctcttctgtctcttctccaaagttaatttatctcatactatttcttgtgttaatattttccaagttcagtatgctgttctggttataagaagatcagtgtcctaatcacacacttttacattatatgaaacatcatacagagttttgtagtctgtataacaatacacagaggtagcaaaatttgtaaaagagcagactatatagtccatactgtagtaactactcaacattgccattatacgtgaaatcggctataaccaattcataaacaaatgaatttggccgtgttctagtaaaacttatttacaaaaacatgtgttaggccagatttggaccacaggctgtagatttctgacctctggcttacagcagaagtttattatgatcctggggaaggtggatatacatggaaggcagaagcgagaagatgtattccatcccatgtcatttttctgaaccctcaacgtaggaagttaaactaaaacatggggcagaatctgctttaagcctttgaattcttggctcttaaagccaggttgagggttatgtgtttttattcttttatatctccttttcacttaggcttggcaactagttcattgaaacagagccaacaagaatgagtgagtcactcagtgatatgaagcaagctgtggtcatttatctactaccttccatacctacttcctaggtttgataagtagtgtttgtagtgtagttgtcagtaacttttctcagcttacataagtttatgtggaattcatttacaaatgtgtgattattacgatagatgttattttataaatttcaaggttctttaatacagcatggacatgtttctaaatcaataaatatagcttacccacagactttttatgggatgtaaagtatgtattacaacaggtaaatccatttctctgttttgggaaagcaggttaatgttttgtttgttttgttgctgcatataatgttgcactatatatatattctaatgcagttggtctcctaattctacaggataaatgtctagctgtggcattgttggatcatcagtttcgtttcagttagatgctgtgaaattgctcttgaaaatggtgtcctctgccaccacagaacggtgttgtaatggaagtgccaattttcataaaaacttgtgtgcaacaggtattaagaatttttgaggtcgggcgcagtagctcacgcctgtaatcccagcactttgggaggcctaggcaggtggatcacctgaggtcaggagttccagaccagcctgaccaacatggtgaaatcccatctccactaaatacaaaaaattagctgggcgtggtggcatatacctgtaatcccagctacttgggaggctaagacaggagaattgcttgaacccaggaggcggaggttgcagtgagccgagattgcaccactacactccagcctgggtgatgagcgaaactccatctcaaaaaaaaaaaaaagctttaaatttttagccaatctaataggtgaaaatggcatttttaacataagtctgacttaaacaattaatggccgtggctaaaagaagaatcaaataatgatgtgtgatttataagataaggaggcagtaccccatttttcctcactctacccaaaaatcctgtttatctgagcaagaaatcattaatattttctaaatccgcttggaagttcataaacgccctaagtataccttataccagcgtttttatgactttgtatttttgaaataattttagattcagaatcgcaagaatcatgcagagcgacctgatttacgcttcacctagattgactttttattctgcatcgttgtgttcttcccccacttcctcttcttgctctcgcctccctttatatgtttatacatagcattatcattttatgtactatttgaatgatttgccgacattatcttcctgtaacccaaaacacttcaacatctactttctaagagcctgagcatcttatattgacttcggtaaaaatttcaaaataatgaaatgtgtcaatagtataaaagtataacagtatgcagtccatattcacattttacccatttttccagaggtgttctttatagcagtttcttcccttctacaacatccagaaaaggatcttctattgcattcaattatcatgtctctttagttttgtttaatctgaaacagtttcctggactttgatcacatcagtgttcttaaaaagtaatagctaacagatttaaggagatacctcagattttgaattttgtgtttcctcatgaaaaggtttaagatactcattttgagcagaaataattcagtattctcagtcttccttagtgaatcatctcaggtgacaaataatgtcactttgtctcactttgaattactttgatctcttggttcgattggtgtccactggacttttccactatagttaacattccttcataattaatttggaactatacaggtattctatttttcatcaaacttccacatagtaggtttaatatgcacaggtgacttttacctgaatcagtgttgattagaaaaaaatctgttattgcttagatgcattatttagtatcttgtactgtaaggaagagtttgtatatcatggcctgtcagaacagtcccgcaatgtgttttatgaactgaaaattctgaaagaataaggtagtgatttatatgagaatacagggaaagggttacccaaagagtctaatgaatttatgtctaaaccatagagtggaatgtgagagacacacagaactccagagttgtgatgcaaatacactgcacagtggaaggagaagaggaagtttttggtaatagtgtttcatctaatgtagctctgtaatgtatgtgtgccttcattattggaagagtgttcaacagttcacagttgaatagactgaagcatgatgctggaatctgggttcagattctagatccgtatcctacatatcaccaatgcttgtttctcaatttttgtttgtcattactttaagtctctttaatgcattagagtatccaaggttgacagtgaagggactgcatttgggagctatctgaagacaaaaacagctttttgaagtttctttcatacgtcaccttacatggcctctcgcattctctgtggagaagtttgtgtagattattcagactaccgtgcagtgactgtgttgtttaaaacctatacatatccaaactctgttttgtgttctctataactagggcattagtctcccaatagtaatcctgcatcttatgctatttaaagaaggttcccagaatacagacattcttacttttgaacaatgacttgggtagattgaggaagtggttttaataatcactttgatatatttcaaaatctggttcattattggtgaggtgcaggccacctggtattaatgaaaatgtgtaattaggaaccagtgcagtggaatcagaggcttgaacatgacctaaggcttggtcaaaagtggtgatctgaatgttccctgctctctgtatgtaactttgtacttagtcttcagtggcagggttgcagcagaggcccagtaaatattgttcattcaacgtatgaaggagaaaatggaagtaaggccaaaaattactgattgtaaacaaatgaagcaccaagtgaataaatgtacaaatagacaagtagccagtaggaaaaaaaacaataattgttacctaaagaatgaaaaccaagtggaaaaggccgccagggacattttaatatgcatattgttgctttcacatataatacagtaagggagtatcagaaaacctgaatctgcctgactaaaacataccctgttccacaaagctatatatatgagagtattgaaggtggtttaataccaaattcaaaaattcagcctcagtgtagcaaacttttaaattttccatgatataaagtaagttttaaccaacaatggaagtcacagcactaaagtacattactattatatgattctctgatggtaatagaaactgtgctgcaggacacgttttgattcaggaagaaatgtggagtaactccacagaggaattcatcctttctaagtttaaatctgaacggaacccatatgcccataccctgaagatgcatgtaagggaacaacatggcttggtctgttgaaaaaagaaaagaaccttcaattaagcattctgtgaacttgataagaggatgcagaggaacgtaaatgcactctgcatatctgtgattgaccttggaacacagtgattgccctctaaagaatagccgagtaagtactgttatcattccaccgatcaaattagagcctcttccttccagtgggagcagagtgacatagaccaaggaaagccgaggagaagattgtagccttttatttctccttatatttgttgaggttcactgctgactgataaacgatttgcacaaaaaaattcaggcctctgactcttctggtatttgatttatctagtaaagttaattccaagacaaaagtacagttggttaaaaataccagtctcatgtttatttgatggtttgaaatattctgttacattgttgtatctcgtttgtcaccttggaatatatgacaatcatgttatcttgattttttccacaagataatttgattctaaaatcgattcattgtttatcttcaggaattagagattttaaaaatgtcatctcatgtctcattcagtcatttccaagatttagcgagtgttctccctaatgccttggataagaatgccttgttcaatggctgtattttactcataattagcattccaactgctttgggtttttttagatttacaatttttatttctgcagtacttaactttctatattttatgtatattaaaacaagttaggtaggatgaagatcactggatgatataaatactaatagcaaaagtagaaataagttgtattatataagttgtacataggtgttacattaggttgtcttacatgaaagtattacaaagtatgggatttggggtgtattttgaaatccttgccagttctacttgataaagtattgaatggtatcatgtgagaggagaagaggacggaaacaggacttatgatttagacctcaacaactgctagggagggttggttttctctgagtgcatgattttttataaaaatgctattttgccagttttagatccatattaaacccacagattaaggttttggtttttaaagtgtaaataggaagcttgagctgggggggaatttggaggtagagataatacttaatcgctgtgggaaaggatgagatctagagatagagtgtatgtgggagtaggaacatatgtgtctgagaccatgctttggatgctctagcatttagatattgagaaaatgaggaagacccattaaaggagattgtggctagagttactggtgaaaaccaaagggttgtagtgttcctgaagatacatgaagagtgagattaaaaattaatggggcagcagtggcttttgcatggcattgaaaagacacagttcaatttgaaaattgagtatcattaatcgtagtgctcttattattgaaaaggccaaatcaaacaatacctttgagttgatggtctgtactataattaggttaccattgttagcccagcatagacacatgctgatacctgtgagttgctttcatcaattagtatgtgaagatgcatcccagttgtacaattttagatcctcttcatcattccacattatatgtatacaagataaaacttgatgttttcattacatcctttcaatcttctaacagcagtccttacgtagctttatcattggagtttccacttgcagtgtctctatctgtacctgcattcattggccacggtagagttttcattacggcaggattgcatttcattgttttggcttgtgtcagacatttagcaaagattgttgaggaaaggaatggatggaaggggccagctgaaagaaaaagtaacaacctaatgatggataagtgaaaaaggaatgaagaaaggatggtgctaggaatcgagggagtaaagcaagatagaatgtacaaaaggtcgaatttttaaagaaagttgtagggcaagggcaaggtgtgttgaacctacatttaaaatacaataacatcactaaagtcgaggccgggtgtggtggctcacccctgtaatcccagcactttgggaggccaaggcaggcagattacctgaggtcagaagtttgagaccatcctggccaacatggtaaaaccccatctctactaaaaatacaaaaattagctgggcgtggtggcgggcgcctgtaatcccagttacttgggaggctgaggcaggagaatcacttgaacctgggaggcggaggctgcagtgagccaagatcatgtcactgtactccagcctgggcgacaagaatgaaactctgtctcaaaaaaaaaaaaaacccatcactaaaatcagggagaaaaaaaccatcactaaagtcagggataaagtaccattgtggaaggtgttcttttccagcttaacctgaagaattgtacagtcattgtacattgtcattccctaactaatgggttagatatgagtctgtagaaaattgtttgtccaacatactttatgcctcttaacatttcacttaccaaatttcatttcattccttcattttgtgtctaacagactagaaataatgagctcctattgacagggatattttcctcttcatactttcctttaccttacagagccttttatgtagcagatatttaatttcataatgggtctaaactacttgtttagaccatggatgagtgaaattttgatgaatgagccccaatcacctgaagggtgagtaaaagaagaatttctagagacccaatatgaagtagctgcttcacacttttttgagaatgttatggcatgactgaggaaatcatagatgctgtagaccatgttgagttggattgtgtaaatatagattctggtattagggaactcagcatctgctggattagacttcttatggtgaaagtctttttttagggattaggcataaatccccactgatatttgtgcagtaatagagtatagctcctgttttctttcctgcttgtatagcctgtgccattagtgtcctctttctcactgttttctcaaaggaaaacagtcaaagaggaagccatatgcatggtagactttgtaatccgggaaaagtcaacatatttcatagtagtgcactttttatgtgttgtcagtccttagaaaggattcattttctccatattatatactactctattttaaaaatttcttgggggagaatggctgtagacaggccaatgatagaatcatagaatatagtcactgtctaattactttcaatcaagagagggaacaataaagtacaatgtatgtcgctgacttcagtgtgaccactcagtatttctgtaacacagtatttatattgctgtacggtagagttatacttatttctgtgatccagttcatttgtttaatattgggattcaaggagtgttgaagaaatgtctactgattaataacagatgggaagagtgtatgtgttttaaataagagaccaagagagacaataaggaaaataagaaggaagtgtttgtgaacctttcacattactcttacattcgggaagtccacaagacaccgtagtggagattctgaggaggtgaaaacctgtagaaaaatgctttattagtaaggagctgactaagttgtcagaaagtgttgatttttagaaggatattgagacattgggtatatagggtatatgactccttgtcttcctttcattctggcttcttaccagctgttgtgaataagtttaagatttcttctgacgttataaacttcagaaaaggtatggctgtttgttcagtttgaagtagtatcatatccgccaaagccttgttcaattgtcttgttgattcatggttctcttcagtgataatattatatgggattcctacccacagccacccaatatctcagtggagaaatgcaggtttggagagaacatctgaatagaatcacgctaagatggtacatttgcactgagaccattgttatgtggcaggcagacatgaagtatcctaggattgatcagtatgccttaatgtaaatagctgcatatagacctgatttcttaggctccccacttcaagctcttgaatattgtgttgatatccttatcaatacactttgtcttgtgttctgtgttgtttttccaaaatataacgagctcctacttgacagggattttttctttctattgtcttacgataaaatgtcaagataaaaatgtatgagtttcattaaagtttattgaataaaatttgtgatggaatgagtgacagcgaggtcatgaatgagagagaatatggaaataatggagaatgtgatattctgatagtcatgcaatattctttttgatataatatgtaacatatattagtatgttatattctatgtattatttgtcatatattattactatatcctgttgctatatttggataatttgggaatctgccatgtttgatgatgttgaaaagagaacataaaatgtagtgatttcttaataaggtgtagaggtgtaggtattaactctttaagaatatagtgatttattttaaaataatgataggaaaggaccataaaaatgtctgaatttgggaaattagaaaatgttttctctctggggctttcatatgtctgttctatgtgaatgtcgctttgccatggctccctctttgctaactcttcttaacccctgcagagaaggaagtgtagtgatggtattttgagtccatcttcaggtttattgggaatgcaagggaaatgagttgttaccaatgggagtaaagggctagttgctatgccagtagctgctacttttgacactgcttgagcaatctgaatggctaggtttgaatctggcttctcagtcagaattttaccttcactctaatgctgctttttttcaaatcacctatatttacataaatatgaaccaacttcagtgatcttaattctttcccgaagatccaagtttctttccatctgcctgaagaactttctttagcacttctggtatagcagacctactgatgataatttttcttttagtatatggtgattagtttactttttattcaactgtgtctttttttgaagtcttcttcattgaaatatattgttactaaatatagaattaatggctttctttaagcacttcaaagataatccactgttttctggactccgttgatacttaagtctttatttttgtgtaattctttttctttaaatgtgccatttttcatttttctctgactcctacctactaagatatttttacctaagtattgagtcagttttggttatgatgtgactcagtgtgtttttatttatattgtttggttgtttgaacttcttgaatctgtaaatgttgtgctttatgttaaatttggggggatttcagccatttaaaatataacttttcagtctcttccccctgggactccaatttttacatatgtattagacctattaatatttttctatggatacctgacattctttttaaatcttatttttggtgtttttcactttgaacaacctaataatttgtttccatccatgttcactcactgtttattctattttttcccaatctgctcttaagcctatcctgtgaattttctttttaatttattttattttttagttccagatattttctgctttttgtttgtttttgagacagaatctttctctgtcacacagggtggagtgcagtgtcatggttcaccgcagccttgacctcctggtctcaagtgatcctctcaccttaacctacccactcctaagtagctagaactacaggtgcatgccaccacgctcagctaattttttatttttgtagagatggggtcgttgtgttgcccaagctggtcttgaactcccagactcaagcagtcttcctgcctcggcctcatgcccgcgccaaccagttctttatttttaatattatgttgtatttgatgtgctatcctattcatttagtataagcacatttttctttatgtcttcagcataattatatgctttttcagaattttaacatcaggactgcttccagggtagctttattgccctttgtcttaagtatggattatagttttcattctttgtatgtcaagtaattttggattgtaacttgaactttgaatatactgtagaaactctgaattctattttattcttctaaaacaatatttctcagcttcagcactactgacattttgaactgggtcattttgtttgtgttgttgtgtgtattttgggagggtactgttctatatgcattgtggggtactgagtattatcctttgtctccactcactacttaccagtagcataactctctctcctccccacatcccctgccaaaaaatgccttcagtcctttctaagcgctcttttttatggtgttggggccaaaatcatgcatctttactcactctttctcattgagagctatggctataaagggtagtgatacttttacttatttatttttaaggcaagcagttaacttagctggattcaaactccaggctgcctcgtgtgctgtgggaagcagcctacgctctattcagttcttttcttttcatattggttgggttactttgagtctggcctacatgatgggcagtttagaggtcaaccaaaggatttcagcagaacttatacacagaatttcattcaggcttcccgtgtctgattggctacagtgtgggaatttcctcccacttttcagccactactgaggatgcctttcggcaaaattccttgaaattggaaacttacagggaaattcctttcctccaagagtgcgctctcctccagtgttggcttgcttttggttgttctccgtggttttagatagctgtctttatattaattctggagtttacagttgatatctgttgggggcttagtttgataacatgtattcttctattactagtagccagacctgtatgtcttacttgacctgatggagaaaagtttcaacttatgagacaatactgtgctagctagttttactgatttgtactctaaagtacccaagcctaaaatagtagagctgtctatcccacatgaaacttctctgattttcactgttttttataaaaagtatacatgttcacatttctgtaggtttttttaagcatcacaatttttataaactttctatatttccaaggtctacctgctttgtattttgcctagtgagagttttgtattcatgtaggaataatctcttggtgtgagtatctattttccactcatccaaaacagatagagcattgatttcactaagcgttatgttctagtttgctttggtattattattagaaatacctggtgattaatttgagctaagtattcttctctaccctcattcccagcattatcacccgcttttaccacttccaaggggtggaagcattctccacaatgcattttttcatgccagagaaaaatctagaaaaaaatgaataaaacgaagaaattctttccccttggtatctgtagctaacttgcctaagtgttctttcccacagtttaagtcttcagtccatagttcataagcaaaggggtgtagcgagctctgatcttgccagaagagagaataagtgagctaccccacggtggacattctggccatctgaaatgagtcgatgcatgtggcttttgtctaaaggctacaaataaaatgtaaccactttcttctttgagtagttgatatagcaaatagttgaaacagaagttttgattggcaaatcaggatgtggtagatactttaacaaagagtagaactattaccagttttatgtgttgctgtttgtatctctttcacagttttgataatatcacatcctggaaagtgaaacagaaaattattattccattttaaatgactaaatttgctttcatggtatttacagtgaaagagtaaattagaaagtgaatggatgactgttcatgagaaaaagcagggtaaaaagattttatttaattaattgaaaatattagggtcaaaacataggcttatgttatgttttgtgaattgtgctgtgttgtagacatttgatgagtcctaacatagaattgatctagctcttgaaataccatttttgattgagtataaatgggatataggcaccttacaacttcagaattcgaggaagatgatgtgaatcttccaattttatctatttgattcaaatggtatgttttttcacatttctcataatttccacgtcaactcccatgatgatcatgcaggaaagcagcatgattgcacttcttgtagtgcataccatcactaaaacatagttactgtctttctgtggtcttaagaaaaattcagaaacagcataccaatgtacatataagataaataagcttatgtggtacagtaagtgttctgttctgagaaataccttgattcgtatcctaatgtctgatgttattggtagttctcaaacttccccaattctgctttcatctaaattcatcttatctatctattgttaaataatctatcagtccatttttatctatcatctatatatctgtctttatcaatcattcgtctgtaatctatctgtgccgtttggcataagagacagaagggcatagcagtggaaactcaaaggagttacctccatgtgaatggacagtggtgatggtgatctgtgaggtggtgatgtatagaaagaaaaactagaagagagcatgccctaactcagggaccttgtccagcaggcactctggccttgttatactgtgcttgaatatgaaaaaaaaaaaaatcaaaatagtgctgacattctttgtcttctgggtctgagaaaacttagagtagatatgatgactctgccatttcagtcttttgtatttccacatttagagctcagttttaattatgtagaattatttctccagcctgtgttaaactagaccatggattggcaaactttttttgtaaattgccaaatacacattttcagttctgaaagccttgtggtctttgttgcagctaatctactctgctgttgtgttatgaaagcagccataggtaatttataattgaatgagtgcgctgtgcctttcttccaataaaactttacaaaagcatcctgtgggctggagtttaccctttgggaaaccagagcattggctaaactggaacctgaaaaaataatcacatcaactcagccacatggtaataatatttagagtattatttcaacattttcattttcataaaaatttttttagctcttttgccaaattccatctgtgagtgatacaaatgactaccacgtgccattaacatcacctaaacagtgcaaaacaagcatagtagaagtaattggaatgatataaaccccttgctgtaatagttatagttgataaattatgtttcaaaattgaacctatttcttccaaatttcatctataaagttccaaggagttccaaaatcttgcctgccttcttttcccagttagcagtattgtctctgagcagccatggtggtatccatcctccttggacaatgaatttagcctattttgacttcatttgagcagttgtaattgtttcaccacatcagagtaagattactacatgccagagctattctttaactcagcttgtaaaaacatgatagcatcaacaatatacatagcaaatgaatgccatctttaatccaattaaatggtttttacaaatttgctcttgtttgttgatgctatctgcattgcagtaattaaaggtgaggtaaaaagaatgaataaactgccaagttaaaattaaatttgggcaatttctcttttgcagtaatgtatgtatatttactcaaaacatatgccaaatttagtgttgaaaggctcattcaaatcaattgggaaagcacgtaaatgaacaattcataaaagaaaagcattgcaaatggccaagagcatagaaaatgtgctcaatcttaccagtcattataaggaaataatgaaatttgtgtatatatgaaatacttaaaatatatataaaataaaacaattatttgccttttttcacctatcagattaacagattatatgtgttaacaaggtggggagaatttacaactcctgatatgttaaaatctttcaggaaggtagtagaaaatatatgtaagatggaaattagcacttttgaccaacaattttagttttagatatttacctataaggatataataggaggtgttcaaagatgcatgtaactcaatgtagtattaattataattgtaaaatagtaaataacatttttgtcaaatcataatgttaggaaaattagtgatggcacatttaaccaattgaattatattcagttctgaataccgtgatgcatgttcaaattaattgatacaaaaatccaacaactttagcagtttgtttaccagttattgagtaccaactgtgttcaacattgttatttcactcatatgaaatgataaatgtatgtgcgtgttatgatacggtcaataaaaccacttttataggaagaatactcacaaaatacagcgagttctggtcattattttattgttgcatttgtgtgtttgtgtgttttgaatacatacatgtatttcaattaactatagcatttattgaatttttatcacatgtaccagatggggagatcaacactttacatgaattataagttataatataataacttatataatgttattatataataacttattattataataacagatggaataacgaatttgtctttttaaaagataagtaaattgaggttgagtttgaattttgtaattcattctattatatagaagttaaataaacctatcctaggatgtcacaacctttggataataataattaaaaatacttatgatttattaaacccattgagcaaaatcatgttttgtgaaagaacccacatttcagaagtcatattcattcttcttttgtctttaaggccagagacatgataattattaagtgcagcttctcaggacagaaagtgtaagtgttggtatattgtaggaacaggagaaaaacatgaataggaacttgtcttttggaaattcttacagtataaacctttaaggagttacttctagaaatatggggtgcctttgctcaggatgtggaacaacatgttcccgggcagaaaccatattatacacaaagctctgagacatcatggaggcacagatgaaagtccaaagagaaatggccagtagaaagaggatcactaaatggaagaagctaactttggaatagagctggtgacaggtaatatgatgacttaaatgctgccaatagcagggaaaaggtccatggtaatatctgagtgaagaaacaattgccaactgatctagatttgaagggcataacctcttggaatatttttccagtgtaatttgtgatcatatggtctggattctacaaaatctcccccattctacaaaatctataatcagttctcttccattttcttcattcattctaacccttttctaaagacggcactttgtgtcttgtgaatgcaatcccttagcagttctcagctagtagctgaaactttggttaaaatggtaagcatgggggattgtgacataaattttgctttgctatggcagttattgaaatatttttataattttgactatttgtcatgtaaggaatgcacagtgccattctaactgtgtatattctggtatttggggggttggaaattgactatatgagattcttgcagctgggtctctgacatgttgagaatgctgaagaagaaaaagtacagaaggagaaagcagagatggggaaagctgcatccctcaaataggataccactggatactgagcagtgaacaacctctggttttgtcggacaccattttggaatatttggacacagtttccggaaggatgagagacctaatcaatggtagtaagatgtttaaaatattattaatacgaatgaatgcttaggcaaggttgacggtaaagctcttctgtacaataggtagcgttaataaagaaatgacaagatttggaaaatcagtatttggaaataatcataattgtttcagccaggaatcatcaaatgatgctaaaacttggagaaaattttaagagaaacaggacatttggtgtccttatcagttacaaagggaaagtagtagcttcctgatggagaacatggttgacagcacctgaattaaagaggtgaaagttaataccacagtagtgggaacatcaggcagcgctgataggatgcactgagaagaacacagtctcatttctgtagtattactgactaaactgcagaaacctgagtctacccatgaggaaacatcagtctcaaattgactgatattttgcttttagtattcaaacatactaatttcactgaggaaatggtccagattatttcagactatatagacatgagaatggaatatcacattggttcaggatgtctataaaaggataaggaaggttggcaaaatttgaagacagtccctcaagtagattatagtgttacgtgagtattaattgcctaagttatataattgcctgaggttatataacagaaaattcttgtttttaagaaattaaaacaatttaaaggataaagggataatgtcatagctgtaattttccaagcatttggataaaataatatacatgtttcaaaaaaaaaatgaaacagatgttgtaagatgttagcaaatagggaatccaggtggaaataatccaggaattatggatagtcttgtatctgttcagcaggtctgaaagtagttgatgaaaataatgcaaaagaacatgtcaaaaagaaatggtttgggcatatggcttcaagcatacataaatgctcaggaaacatgaaaatgtgaaataaatggatgagtactataataccagcaggccttgtagatacctgcatttgaagcatttatattagaaggaagcctttttacccagaatttttttcacttagcctaatgttttcaaggtttggccatgttgcagcatatatcagatctccattttttttgatggaggagtgatattctattgtataaatatatcacattttgctcatccactcactagtttttggctattatgactaatcccgccaggaatatttatgtggaggtttttgtgtgtttatgttttcaattctattatacatgagaatatagtaactgtgtttatttgacattttgaggacctgtctgtaagtgatgtttaagataatttttgttacatttgaaggcagataatagtctatgcaaaatgaatattctgttgaatattgatgtgaactattcttattgtaaaaaaaaagttacattgaaatagtaagtatagaagttatatcttggtggcggggcgtggtggctcatgcctgtaatcccagcactttgggaggccgaggcaggtggatcacagggtcaggagatcgagaccatcctggctaacatgatgaaaccccatctttactaaaaatacaaaaaattagctgtgcgtggtgatgagcgcctgtagtcccagctactcaggaggctgaggcaggagaatcacttgaacccaggaggcggagcttgcagtgagctgagattgtgccactgtactccagcctgggtgacagagcgagactctgtttcacccaaaaaaaaaaaaaaaaaaaaaaaaaagtattggtttttgtactcaacaagcagttttatgtttttatttttcaggaactctccaatactgaattcaggctgggatattagagaaaaggaaaatacatgaaactcagtggtgttttatggcactttgagttccccaattcaccttcaaacatttagccttccaagttctctgccaccgtatcagtgcatccctcctgagattcttaattctttgattgtgtaaagatggactatgcttactccatcttacttctcttaggtcttacaatggaagtgccctattacattttgttcttttctatgatttccaattattttatgaaatttttcatttattttttctgttctttctatctttaatttctatgtaactttttgaaatagatctcaaagattttatatatatatatatatatatatatacacacacacacagagagagagatatatatctactgtactattgaagtagattcctaaagtttttatctcttctagaatattggtttcacaacacccctattatgtgtatttaattttacccaccacatggcgttttcaaaaagtctttatttggcggaatacaacttcagaatctgattcgaagagaaaattgctcacagccgtgagccactgtgcctggccgatttttactatttaaagaaggaagaattttagcagcgtggggtggctcatgcctgtaatcccagcactttgggaggctgaggtgggcggatcacttgaggccagtagttcaagaacagcctggccaacatgacgaaaccccatctctactaaaaatacaaaaattagccaggcgtggtggcacgtgcctgtagtcccagctactcgaaggcttaggcaggagaatcgcttgaatcagagacagggaggctgcaatgagccgagattgcaccactgcactccagcctgggcgacagtgcaagactccatctcaaaaataaagaggaattggaggaggaaataaatgaataaatgacaaaggtgacaaaggaccaaagatctgtgacttgtgcaaagattgctctgtggtaattattacagaaacaatgtttgtatcttattttttagggaattttgtatattgtctaatctgatttactttgtttttaatagtttgctgcaggtctagaagatgtcacagaatttcaaggaagagaggtgagcagctgctgtggtgattttgaaattgtttgtgtgtgttgtggccagtgatgtcagaatttcaggatctgagagttcatgattttagaggctcaaaggagaatatttttataacttttttctataatttttttataatttttttatatattttttataatattttataattttttttgctatgtgagtatccctactttgttcaaggaatctcattatcttttccctttttttaaaaagggatttttttgtagtaacctgaataaattgggggaagtattgatatatttccttttctcaccattttttgttggatgaaaataatcttttagtgaaattcagtgtattaaatatttattttttaaagtctagagatggggtcatgctgtgtttcccaggctgcccttgaactcctgggctcaagcaatcatcttgcctcaacctcctgagtagctgggactacaggcatgtgctgccatgcctggcttaaatatttaaaaaattttatctggcacattctgaacacagatgtttctacttatatttgtcatgtagtcacagtatatattgattttgctacctcgcctactcctaaaagttttaattcatttaattggtcttaattggacttaaaaattttttccctggccgggcgccttggctcacgcctgtaatcccagcactttgggaagccgaggcaggcgtttgagaccagcctgaccaacatggagaaaccctgtctctactaataatacaaaattagctgggtggggtggcacatgcctgtaatcccagctactcaggaggctgaggcaggagaatcacttgaacccgggaggcagaggttgcagtgagctgaaattgtgccattgcactccagcctggacaacaagagcaaaactctgtctcaaaaaaaaaaaaattcccaatagattttaatctaattttattagaacaattcagtcatatgttttttcatgctatgtatatgagagttccattattcagatactaaacaaatgtctactgtacatttactcttctcactgatgatggattagataaccatgcacaaaataagcctggctgtggaaatgcttatttgttgggagggtgcttgtttggatcgatgatgagaataattgtctgaggatgctgagggactcattccagatgtcaatctgaggtccagatgtgtggccctccaataggacaaataagactctcagagcctggctctatttggggatccctcagtgacaacatagtacctctgtgagcgtgccttttctatctctccgaagagggcattagcatcctgtcttatgagtcagtatgcactttagtatggttagtgacccaagactcactttattttgttcattttgagcagagaattgtagatagatacatatatgggaaatatgttcttgattaacaaatgaaaaaatgaaaaagtttcagtcaagaaaggtcaaggaactgtgatgtatagtgaaggcagggaacactgcatgcctgtattaaatattgacaaaggaaccaattttagtgctttgttatttttactgttgagtattttctgagaccatttctttttcttctattttgttttgctgaggtagaggagggctggaatgaggtcctccacttcagaaaataggggtgagtagttaaaccaacatcctttggaattcatatacgtcatgcgttccatgccacatcctgagatctttttgttgatttttttagtggcttactggataatatctaaatactgtatattttactttggtgagtctctccaccttcatttctgaatcattgtcctttacatttttattctatttgaattttgcatgaaatgacaaatgtagaattttgcccaatttattttatttattcatttatttatttgggaagacaaagtctctctctgtcacccaggctggagtacattggcccagtcagagctcacttcagctcttcaccctgtagcccttaactcctgggctcaagtgatcctccaccctcagcctcccaagtatctaggaatacaggtatgtgttaccacacatagctaatttttaaattttttattttgtgaagataggatcttactgtgttgctaaggctggtcttgaactactgggctcaagcagtcctcttgttttggcttcccaaagtgctaggattacaggcaggagccaccatgcctggcatcattagggatattggtctgtgattcacttttgatgatgtctttggttttgataaaaattagggtaatagtagactcatggaataagttgggaaatgttttctgctctcctgttttttggaagagttgtgaaggattgatgttatttctttaatgatttggtagaattcatcagagaaatcatttgtgtggaattttatttgtggaaacttgagtagctaattcaatctcttgttaaaggtgacttcaattttctgtttttccttcttgtgacagttcctgtaatttatatatttctaggaatgtgcctatttaatctaggttatgtaatttgttgacataacttgtttatataagggtgttagtctgattttcatcccagattttatgaaaattgggtcttctgttttcagtagtgtagatatagttatgtcaattttttaagagacagagtcttactgtgttgtttatgctggccttgaacttctgagcctaagcaatcctgctacctctgcatcttgagtaggtgggagtgtgggaacacaccaccacacctggcctgtcactaaacaaacaaaaaatttcagtgaaccagcttttgatatttttatttttcttctgtattttttattttatttattggcattttattcttatatcttttattctacttgatttagctttgctttgtttttctgttttcttaaggtaaaagtttagattattgatttgagattttcctttttttaatatggacatttacagctataaatttcccaaagaactcttttagctacatatatattttcttttgttgtgttttgtttcctttgatttcaaactattttataaattttcttatttctcccaagaactcccaatgattcttagtaatgtgttaatttccatatattgtgaattccccccaatttttttcctttatttctgatatgattctattgtggttggacaccatacttttctgatttctttactttcagatttgttgataccagtgtgtggtctaatacctaccctgcacactgttccatgtgcacttgaaaataatatattttctactggttagattgttccatagatggatgttatgtaactgttttatagtgttgtttgtcttctatttccttgatcttctgtctcattgttatgttcatcattgaaagtgaggtattgaaattttcagttattataatgtttattttgccttccattctgtcatttttaaaatttaatttgggggttatgttgttggatgcacgtatctttattattgttatatcttcctgatggattgacagtttaatcatcatgaaatgtcctttgtctctaccaacaatttttttttttttgagatggagtctcgctctgttgcccaggctggagtgcagtggcaccatctctgctcaccacaagctccgcctcctgggttcacaccattctcctgcctcagcctcccgagtagctgggattacaggcacctgtcaccacgcctggctaattttttgtatttttagtagagacggggtttcaccatgttagccaggatggtctcgatctcctgacctcgtgatccacccacctcggcctcccaaagtgctgggattacaggcgtgagccaccgtgcctggccctctaccaacaatttttatcttgaaatttatttagcctgataattgtagtttttgtctgacttatagcccataaactctctctggttactgtatgcagtttatcttgtcattattttactatctacctatttttaattaaaacaaaatatctttgagacaggatctcactctctcacccatgctgtagcgcaatggcatgatcatagctcactgcaacctgaaactcttgtaattcaagcaattcttccacctcagcctcctgagtatctgaaactacaggccaacaccaccacacctggctaatttttttgtattttttttcttgtagagatgaaatcttggtatcttgcccaggatggttattttctacctattttttgtccttgaatctaaagtgtatcttttgtagagagcatatagttgtatcatgtgtttttttaaaaagatacatctctgccttttaagtggagagtttacttcatgaacatttaatgtaattactgataaggtaaaattcacatctgccattttctattttcttttatggcatatatctgttttgtttttcttattgttctttatgttaaataagtaatagtgtactgctttaattttctttttaattttttgtgtttacttattagtggttgcctttgagattatagttaatttgttaatttataatatagcttagatttaatagttaattttaatagtacacagaaactatttttcaatatagctctgttttctcacccttccttttgtatattattgtcattcaaacatttataccatcttttatatttgcctaataattattttactggtcctgtgcatttcttcatatggatcaaagttaatgtctagtgctatttcacttaaggctgaagtctccatttaatttttctggtaggataggtattttgacaaattcagcttttgttggtttagaatgtcatttcttttttatttttgaagagtacttttgctgtttcaagatctatgggtagacagtcttacttctttttctttaaaatagtttgaatatgttatcttactgttttatggcttcaagagtttctgatgagaaatcagctgttagtctcattgaggattccttgtacctgatgggtttgtttttctcttcatattttgaagactggcttttgaaatttttactatgacgtctccatgtctttatgtgtatctcacttgagtgagtcaagttcatttgactcattttatatgtacatgtatgtttttcccttacattaaggaaattttaggcgtttgttcttcaaactgtttctgcccttctactgtgacttttatgaacatgttgatatgctgtgttcctcagttctctgaagctgtttttcttttttctttctgcttcacagaatggatctcctcaactgtcctgtattcaaattcgattaccttttcctgctagctcaaatagtgtgattaaatttttctagtgaatttttattatttatttctctgtatctttattgtctagtaattgatacatttttaaaaaatttaaattttaggtttaggagtacatgtgcaagtttgttatataggtagattgtgagtcatgttggtttggtgtacagattatttcattacccaggtaataagcatagtacctgataggtagttttttgatcctcactctcctcccaccttctaccttcaagtgctcccagttacaagagagaatgtatggcatttagtttactgttcctgcatcaatgtgcttaggattatggcctccagctctattcatgttgctgtaaagaacatgatttcattcttttttcatggctacatagtattccaaggtgaaaatgctccatattttctatgtccagtctaccagtgtgatagttaatattgagtgtcaacttgattggattgaaggatgcacagtattgttcctggatgtgtctctgtgaaggtgttgccaaaggagattaaaatttgagtcagtgaattgggagagacagattcaccctcaatctgggtgggcacaatctaatcagctgcacagtctcatcagctgctggtagaataaagcaagcagaagaatatagaaggactagactgtctgagtcttccagccttcatctttcacccatgctagatgcttcctgcccttgaacattggacttcaagctcttgtactcttggacttacaccagttgtttgcaaggggctctcaggccttcagcccacactgttggcttcccgacttttgaggttttgggactcagactagcttccttgctcctcagcttgcagaggaactattatgggacttcaccttgtgattgtgtgagtccatcctccttaataaactcccttttatatatacatctatcctattagtcctgtccttctgggaaaccctgactaatacaaccagtcctgggtacctgggttgattgtatgtctttgctcttgtgaataccacagtgatgaacattgaagtgcatgtgtcttttggtagaatgatttattttcttttgggtatataccagaaatgggattgttgggtgaaactgtagctctgttttaagttatttgagaaattctcagactgttttcctcagtgaccggactaatttacattcccaccaacagtgtttaaacattcccctttttcttcaggcttgccaggatctttctcttttttgcttttaataatagccattctgacgttgtgagatactatcttattgtggggttttttttgttgtcgtcgttgtttgtttttcgagacagagtcgcccagggtggagtgcagtggtgtgatctctgctcactgcagcctatgcctcccgggttcaagcgattctcctgccttagagtcccaagtagctgggactgcaggcgtgtgccaccatgcctggctactttttgtatttttagtacagatggggtttcaccatgttggccaggctggtctcgaactcgtgaccttgagtgatccaccaccatggcctcccactgctgggattacaggcatgagccaccgcatcgggcccttatggtggttttgatttgaatttctctgatgattagtgatactaagagcattttttcatatgtttgttgaccattctatatcttcttttgaaaagtgcctcttaatggggttgatttttgcttgttgatttatttaagtgccctatagattcaggatattaggcttctgtcaaatgcatagtttgtcaatgatctctgttcgccaatgatatggttctatacctagaaaatgccttctttaagaaaataaaattgtattttgtggatgtatcacattttccttatatatctgctttgggcatttgggttgcttctgcctcttgggcattatgaataatgctacagtgaatatggatatgcagatgtatgtttgagatcttgctttgaattactttggatatatacccaaaagtgggattcctggatcatatggtaattctattgttaatttttcaggaacctccatacatttttccacaatggctgtaccattttatgttcccatcaacagcatgcaaaggttccagtttctccacattgtcaccaacacttgctgttttttatttcactcttgttgcccaggctggagtgcaatggcactgtcttggttcactgcaacctccacctcctgagttcaagcgattctcctgcctcagtctccccgagtagctgggattacaggtgcctgccaccatgcccagctaatttttatatttttagtagagacagggtttcaccatgttggccaggctggtcttgaactcctgacctcaggtgatccacctgccttggcctcccaaagtgctgggattataggcctgagccaccacgcctggctcgttgtttttcaattgtatcttctaatggatgtgaggtgatacctcattatggttttgatttgcatttgtttagtaattagtgatactgagcatgttttcatatacctgttgtccatttgtttatcttctttggaaaaaaatctattcaattactttgccccttttttaaaattagggttttttgttgtaatctgagtttgttccctccctccctcactctctccctccctctcttccctccttccctccctccttccttccttccttccttccttccttccttccttccttccttccttccttccttcctttcttccttccttccctccctccctgtctccctccctgtctccctccatgtctccctccctgtctccctccctccctcccttcttttctcccttcctccctcccttcctccctccctttctcccttcctcccttccttgatcacatccacatccttccttccttcgtgctgtgttgctcagcatggagagcagtgccaaaatcatggctcactgcagcctcaactttccaggtgccagagagcctcccacctcgtgctcgtgggaccacaggcacatgccaacacgtctagctaattgttttttaatttttattttttggtagatatgggggtctcactgtgttgcacaggctggtttcaaactcataggctcaaggaatcttcaaaccatggcctctcaaagtgttgacattacaggcatgagttaccatgcccatcctgcatgtgaaagccttacgagatatgatatgcaaatatttctctcatttggtacgtttcctctttcattctgttgattgtttcccttcatgtacaaacattttaggtttgatgtagtcttgcttgtctgtttttgcttttgttggttatacttttagtgtcacattcaaaaacttattgacaaaaacaagaagggtttccatgtgttttcttctagttttacaatgtcaagatgtatctttaagtacttaatttattttgagttgatttttgtgtatgttgtaaggtaaggattcagtttactttttttttttaatttgcggatatccagtatgccaaatatgattagttagataaactgtgctctgagcacccatgtcaaagataaattgagtagagtacatggatttatttctgcattcttcattcttttccattagattatgtctgttttttgccagtattctagtattttgaattactatagctttgttatatacttggaaatcaagaagtgcctccacctttgtgtttcatgctgaatattgatttagctattttggttcttttgtggatccagataaattgtatgatttttttctctatttctggaaaaatgtgattgtgattttgataggaattatagtgaatcagtagataactttgggtagtatggatattttgacaatattaattagtcccagtggtggtgttgaggccgtgttgacctggaggcactggggtcagtgatagtgttgtcaagttggctgcaggatgggatggtgcctgggaggtcagtgcataaaaatcctatggatgtgatcaaggaaagggtgatggaaggtgatgtgtcctgtctgcttggtccttgtaggatcaggcaggacatcctgtaataaaaggagacattaccttcggatgtcctgagggcatggtgcaggcaccaggactgagtggaggggaggaagctcatgtcttgaggtcctttggctacatggggaagactgtctctgggcttgatgctgagttccagactgacgtgctggctgttgtgatggtgctctccagtgctggttgtggttggtttttggctaggtacacctcacctgggacagtggccaaagacagtgtcagttccagacatcagaagccccatgaggaagagcatgtgctcgcgccaggagtggtggctgttaggggagggacctcagacctatgtctgcatggcctgaggtcagagttcacatcctactgattgaagaccttgttcttgagctgtccggttgccacagggtcggacctggaggctgcagaccatcgtggccctttgcagtgttcggaaacatatgcgcaccccagggagggacacacacacacacacacacacacacacacacacacacacacacgcaaactcacaaacacaacacacagacagaaaatgacaaataaacacacacactcacacacacacacacaggagcccacagaaaaaagcaaatagacgcagaaacgggcacgtgcagtagttctggccacacatgttccctaggtatccacagaatggcatgggtattgtatattcataaagatggagatcagtcatggaggccaaggacaagtaggtgcactggttgaactacagtagagaatggcatggaagtggtgagcaatggacctgggcctgtttctcaagtgtgtatttgatttctttacaattccccggagaagttgtcatgggaggccagccgcctgctggcaaggaagatggttgattcttctgatcaatggaggccctgcagagtcctgtagtcactgtggcctggcatccatggtgcacccaatgctggtggatggcttaggacggtaagcattcctctgccccacgtgctgaatgagagtggcttttggatgtcctataccttcaaggagctgtttgtcagcagcgaatgacatggcaagttccactcctagagtggatggtctgtgcccattgctcagtggtgcagctctggcttccccagcatgctgaatgtctttaaggtcatcagctcgccccttcccagcctgtggtgtcaaatgtcttgccccttgtcaaatgtgcttggatcgatgatgagtcccctataaaaacattccttggaaaagctgaacaaaatgagtgagaactcataacgtcattctcatcggaactgaggtccagcatgttgcttcctctggggcctgtaggagtgagggacaacttccactgattcccataggttccaccacccagggcatccacagacaaaagtctcgtgtcacaggcacgttaggaacattccctctgtgtgaggtacatgggtgggagagtgatgggggattcggccgctctgtgatggcgtggtggccgtggaagcaggcagaaatgttgcaggcctaggggaagtggaaatgttgccagcacaggggtgtgtgctactggtaagctcccagaaggaagacccggacctcacagtggtcatctcagtgcagaagaccaggtgtctgttttcatgtcgaggagagcccaaggcccagacctcaggcagaccttggtgttgatttttgattagttgagaacaggggagtgccaaggtgttaggggagagtgcagagcaataggtgtcggggcaaacagtgaaagcctcttcagcctaccctgcagcattggtcaccaggagccctcctggaagggatttctttgcctcctgagctgtgagatgcctgtggtgcagtggcagaggcctaggtaggaaggtactccaggggaaaggtggtagagggatcacatggacatgagtgtcattagcaggcttgggctgtcattcaggggtgatgggcttcccatggatttttctggtggaagacaggttggccagcaggggtcttcgaggccaggtcctggggagcacgaggatcgagttggtgcccgtggccctgggtcacttccagtcttcccaggagagtaatgggctcctccattgtgcaaatcttcctataaatggtctcttggcccgccattattgggcggctccacctgctgcagcttgtatgagcaaatactgctctggatcctctttcctgcttggaaagcagcttcagtcctgaaggtccagagtgaatgtgccctgaccctggctctggcccaagtctgtgccgtaggtactcgtcacacttggagctatccatggaggtctgtgtgcattccaggcaacacgggtgcaatcccaggggtgctgccacagagtccttttacttgggatgcctcacacctctgcatgttggcaatatttaagtgttggagtccactacaccctaggggtgatgaactgttttggctcccttaaccggtttgaagtctcagcgcagccaggacagccatgccatgttgaagggcatgcagatggcttaggaatgttggaaaggatgggtggttctgagctcgcagctcactcactagctgcatgcatgtagacccagtggtggtgttcaggtagtgttgactttgaggcattgcggcgggtagtagtgcagtcaagttggctgcataatgggatgttgcctcagaggtcagtacaggatagccctgtgggtgtgtccaatgcaaggaaaatgaaaggcagtgtatcccatccgcctggtccttgggacatcggtaggggggacgtcccattggaaaagcagccattccgtttgtgtgtcgagagggcatagtgcaggcacatggactgagtggaggggaggaaggctgtgtcttgaggtcctttggctagattgggaagaccacctctggccttgacgccaagtttcaggctgatgtgctggccattgcaaaggcgccctccagcacaggttgtgattggttttccaccaggtacgcctcacctgagagggcggctagagacagtgtctgctcaggacatcagatgtcccgtgaggaggagtgtgtactcacaccaggggagttgactggtaggcgagccaccttgggcctatgtccgcatggtctccaggtcaaaattcacatcctactgattgaaggccttggtcttcagctgttgggttggcgtggtgtcaggccaggaggctgcagactatgactgcctgttgcagtgttgggaaacacacatgttaggaaacacatgtgcatgagggagacacacacacacacattcatacacacacacacacacacacagaggcatgccgagccacaggcaaatacatgcagcaatgggcgtatgtgaccacgtgcacttttaggtatccacagagtaacacatgtaagatatattcatggagatggaggtcagtcgtggaagccaaggaataacgggtgtgcaagttgcccaacgggaaagaatgggattgaagtgttgaccagtggacctgagcccatttctcaagcgtttatttgatttctttacacttctcagaggcagttgctgtgggaggtgtggtaactgctggaaggaagatgctcaattcttctgagcaacgaaggccacacggagtcctggattctgtgtggcctggcatccatggcgcactgtgtgctggcaggtggctcaggacggtaagcatttctctgcccagtatgctgaatgagggtgtctttcggatttccaagacccgcaaggagcagtttctcagctaaccactaatggcatggcgagttcctctcctagagtggatagtctgtgctcattgctcagtggcatcgctctagtggggccgaaggtctttaaggtcattggctcacccactgcccagcctgtggtgtcaaatatcctgccccttgccccttcaaatgtgcttggatcgatgatgagtccccaaaaaaaacattccttggaaaagctgaacaaaatgagtgaaaactcataccgtcattctcatcggaactgaggtccagcacgttgccttccccggggactgtaggagtgagggacaacttccactgattcccataggttccaccacccaaggcatccacagccaaagtctcccatcaaatgctcattaggaacattccctttttgtgaggtacacaggtaggagagtcctggggggaacggctgctctgtgatggcctggtggccatggaagcagacagaaatatcgcaggcctagggtagtgtgcgcctgatcttggcttggtgagctcctaggaagggagacgcggacctcgtggcaggcgtctctgagcagaggactgagtccttgttttcttgccggggagagcacaaggcccaggcctcaggcagatgttggtcctgatttttgattagctgaggacaagggagtgccaagggtgatgggggacagtgtataacaaagggtgttgtgacagagagccaaagcctctttggccctccacccagcatccagtcatggaggccccccagcagggatttcttcatcccctgagccgtgagatgcccctggtgctatggtggaagcctggactggaaggtactccacagaagaggtggtagggggcttatgtggacatgtgtgtcatcagcagtcttgggctgttgttcagcgttgatgggctttccatttatttctctagtggatgacaagttggccagcagaggtgtcagagggcaggttccagggaatacaagggtcagacttgtgctcctggcccttggtcacttctcgtcttcctgacagagtagtgggctccactgttgggcacatcttcctggaagtcgtctcttggcccgccattgccgagcggccacacctgctgcagctcgtgtgagcaaatatggctctggatcctctttcctgctttgaaagcagcttccatcctgaaggcgtccagagggtatgtgtcctggccctggccaggaactctgctgtgggcattggtcacacgtggctatccatggagatccgggtgcattccaggcaacattctaggggcctgccatggagagttcgttgacttgggatgcccctgcacctcccatgttggtgatgttccagtgttgcattctgctacaccctaagggtgatgaagcatttcagctcccttaaacagtttgatgtcacagtgcagccaggacagccatatcatgttgaggggcccacgactgcattaggaatgttggaagggattggtggttctgcagatcgcagctcattagtagctgtttacttgtagacctggtgatggtgctgaggcagtgttgacttgcaggagttgggatgggtggtaatgcagtcaagttggctgcatgatgggatgttgcctcagagttctgtgcagagaagccctgtgggtgtaaccagtgcaaggaccatggaaggcagtgtgtcctgtcaacctggtccttggggaagggacgtcctgttggaaaacagccattcccttcggttgtcctgaaggtgcagtgcgggcatgtggactgagtggaggaagcccgtgtcttgagatcctttggctaggttgggaagattgcctctggcttgatgccattttcagacctatgggttggtaattgtgaaggcgccctcacgtgctggttgtggttggttttccgccaagtgagcctcacctgggagtgcagccagagacagtgtcaggtcacaacatcagatgccccatgaggaggagcatgtgctcactccaggggtggtggctgttaggtgagggacctcaggcctatgtcctcctggcctgattttacatcctactgattgaagaccttggtcttgagccttcgggttgcaggggcttcaggtctggaggctgcagactatggcctcctgttgcggtgttgggaaacacatgtgcatgagggaaacacacatacactatcacacacacaaacaggcgctcacagccacaggcaaatatacgtagcaccacgtgcgtgtggtcgttccggccacacgtgcttcctaggtgtctagaaagtgacacagtcagatacatttataaagatggaggtccataatggaggccaaggagaagcgggcatgtgtgttgctctgtggaagagagtggcgttgaagtgaccagtgaacctgggcccatttctcaagcatgcatttgatttctttacacttctcaggggcagttatcatgggacacccgccatatgctggcaaggaagatggtcagttcttctgagccacaaaggcccccaacatcctggagttggtgttgcctagcatccacggtgcgccccctgctggtggatggctcaggatggtaagcattcctccgccgcacatgctgagtgggggtgggatttccaagacctgcaaggagctgtttctcagcaggccactgatggcatggcgagttccactcctaaagtgaacggtctgtgcccattgttcagtggtgcagctctggcttccccagcgtgcggagggtttttaaggtcatcggcttgcccactgcccagcctgtggtgtcaaatatcctgccccttcaaatgtgcttggatcgatgatgagtcccccataaaaacattccttggaaaagctgaacaaaatgagtgagaactcataccgtcgttctcatcggaactgaggtccagcacattgcctcccccggggactgtaggagcgagggacaacttccactggttcccagaggttctaccactcagggcgtccatggatgaaagtctcacatcacaggcacaatagaaatattccctctgtgtgaggtatacaagtaggagagtcatggggggattggctgctctgtgatgtcgtggcaactgtagaagtgggtggaaatgcagacctaggggagtgtgcggctggccttggcttggtgagctgccaggaagggagaccctgacctcctgatgggcctctctatgtggcggaccaggtcttttttttatgccaaggagagcacaaggcccagacctcagacagaccttggtcttgattttcagttatctgaggagaggggagtgccaaagtgatgggggacagtggagagcaatgggtgttgtggcagacagccaaagcctctttggccctccccccagtgttggttacaggggcccctggcagcaatttctttggctcctgagccatgagttatccatggtgtggtggctcagcctgggcaggacagtaccccagagaaaaggtggtagagggctcacatggacacgcgtgtcatcagtggtcttgggctgtcatttggcagtgatgggctttccatggatttctattgtggatgacaggttagccagtggggccttcaagggcagatccaaggagcatgagtgttgggctgtagcccgtggccctcggtcacttctggtcttcccggcagaatagtgggctccaccgttgtgcacatcttcctggaaatggtctcttggccctccattgctgagcagccccacatgctgcagctcttgtgagcaaataactgctttggatcttccgtcctgctttgaaagtggcttccatcctgaagactttcagagggaatgtgccctggccctggccctggctcggaactctcctgtgggattcggtcacacttggagctgtccatgggggtctgtgtgcagtccagacaatgcatatttaatcctaggtgccttccatagagagtcccttgatttgagttgcctctactcctctgcatgttggtgatactcaagtgttggatttagctacgccctaggtgtgatgaactgtttcaaccccgttagtctcagcgtagccaggatagtcatgccatgttgaagggcatgcagatggcttaggaaagttggaaaggattggtcattctgcggctcgtggctcacttagtagccatgtgcatgtagacctggtggtggttgtcagatgtcgttgagcaggtgttggggaggatggtcctgcatccaagttggctgcgtggtgggatgttgcgtcggaggtcggtgcaaggaaggcctttgagtgtgatcgatgcaaggatgatggaaggcactgtgtcctgtctgcctggtgtttggggcgttaggcagggatgtcccatgggaaaagcagccattccctttgggtgtcctgaggacatggtgcaggtacatggactgagtggaggagaggaagcccgtgtcttgaggtcatttgcctaggttgggcagactgcctgtggccttgatgctgagtttcagagtgacgtgctggccgttgcaaaggcgccctccagtgctggttgtgtttggttttgtgccaggtgtgcctttcctgggagtgctgccagagacagtgtctggtcacgacatcagatgccccgtgaggaggagcttatgctcaggctagggatggtggctgttatgtgagggcccttgggcctatgtctgcatggcctcgaggtcagagtttacatcctgctgattgaaggccttggtcttgaattgttgggttggtaggggctcaggtctggaggccgcagactatgactgcatgttgccatgttgggaaactcgtgttgggaaacacatgtgcatgagggagatacacacacacacacacacacacacacacagccactcagcaatgtgtgtgtgcgcggtcggtctggcgccacacacagctccaagctgtttgcagagtgccactggtaaggtacattcatggaaacagaggtcactcatggaggccaacagaagcaaggcgtgcaagttgccacgcatgaaagaatggcactgaagtagtgaccagtggacctgggcctgtttctcaagcgtacatttgatttctttatacttctcaggggcagttgccgtgggaggcccgctgcctgctggaaggaagatggtcagttcttctgaaccacaaaggccctgcagagtcctggagtctgtgtggcctggcttccagggttcacctcatgctggtggattgctcaggatggtaagcattcctctgccccatgtgctgagtgacggtgtcttttggatttccaagacccataatgagctgtttctcatgaggccactaatggcatggtgagttgcattccttgagcaaatggtctctgccttttgctcagtgccatggttctatcttccccagggtgccgaaggtctttaaggtcgtcagctcacctactgcccagcctgtggtgtcaaatgtcctgcctcttcaaatgtgtttggatcgatgatgagtccccccaaaaaaacattccttggaaaagctgaacaaaatgagtgaaaactcataccgtcgttctcagcggaactgaggtccagcgcgttgcctccagcagggactgttggagtgagggagagcttccactagtccctataggttccaccacccagggcatccgcaggtaaatgtctgccatcacacgcacattaggaacattccctttgcgtgagatacactgttaggagagtcacggagggattggatgctgtgtgatggcgtggcagctgtggaagtggacggaaaaatctcaggcctagaggagtgcgtggcactgatgagctcccaggaagggagacccggaccttgtgtcaagcttcctcgcacacaggaccgggtcctggttcccctactacagagagtatgaggtcccagcctcaggcagaccttggtcttgattttcagttagctgaggacaggggagtgccaagggtgatggggaagagtgcagagcaatgggtgttgtagcagatggccaaagcctcttcggcccttcccccagcgttggtcccagggtcaccccagcatggatttctttgcctcctgaaccgtgagatgcccatggtgtggtggtggagacctgggtaggacatattctctggtattccagagaaaaggtggtagggggctcacatggacaggtgtgccatcagtggtcttgggctctcatttggtggtgctgggctttccgtgtattcctctgatggatgacaggtcgggcagcaggggtcttcaagggcagttcccaggcgtgtgagggttgggctgctgcctgtggccctgggtcactccgatcttcctggcagagtaatgggctccaccgttgtgtacatcttcctgtaaatagtctcttggcccgccattgccaggcggccccacctgctgcagcttgtgtgagcaaatactgctcttgatcctttttcttgctttgaaagcagcatccgtcccaaaggcatccagagggaatgtgccctggcccaggcccaggaccctcccgtgggttccaatcatgcatggggctgtctgtggaggtccgtgtccattccgggcaatgcgtgtgcaatcccaggggtgttgccacggaaagtctcttgacttgggatgcctccacgcctctgcatgttggcaatgttccagtgttggattccgctactccctatgcatgatgaagcattttagctcccttagccagtttaaattcacagtgcagccaggacagccgtgccactttcaagggcacttggttggcttaggaaagttggaaaggattggtggttctacagttctcagttcacttagtagctgcatgcatgtagacctggtggtgctgatgcagtgttgacttgccagtgttggggtgggtagtagtgcagtcagattggctgcatgaggggttattgcttctgaggtcggtgcagggatgccctgtgggtgtgtccaattgaagaacgatgacaggcagtgtgtcctgtcaacctggtccttgggaattcaggtagggacgtcctgttggaaaagcagccattctctttgggtgtcctgagggaacggtgcgggcacatggactgagtggaggggaggaggcatgtatcttgaggtccttttgctaggttgctagtcctacctctggccttgatgccaagtttcagactgacatgctggactttgcaaaggcgccctctggagctggttgtggttggttttccgccaggtgcacctcacctaagagggtggccagagacagtgtcttgtcatgacatcagaagccccatgaggaagaggaggagcctgtgctcctgccagaggtggtggctgttaggtaagagacctgtgacctgtttccacatggcccggaggtcaaagttcacatccagtgatcgaaggccagggtcttgagccatcggattgctggggggatcaggtctggaggctgcaaactagaactgcccattgtggtgttgggacccacatgtgcattagggagacaaacatgcccatttaaactaacattctcacacatgcacacacccacacccacccatacacacacactctcatacactcacactcaaactcacactctctctttcacacacacacacacacacacacaggcacagacagccataggctaatagatgcagcgatgtgcacatggtgtggttctggccacatatgcttttaggtgtccacagagtgacgcaggtaaggtatattcatggagctggaggtcagtcatggaggccaaggagaagcaggtgtgtgagttgccctgtgggaaagaatggtgttgaagtgtccagtgaacctgggcctgtttctcaagcatgcatttgatttctttacacttctcagggacagttgccgtgggaggtccgctgcctgctgtcaaggaagatggtcgatgcttctgagaaacaggccctgcgggttcctggatttggtgtggcctggcatccacggtgcaccccgtgctggcgggtggcccaggacggtaagcatttttctgccccgtgtgctgagtgatggtgcctttagaatttctgagacctgtgagcaacagtttcttggcaggccattaatggcatggcgagttccattcccaaagtggatggtctgtgccggttgttcagtggcgcggctctggcttccctagggtgccaaagttctttaacgtcatcggcttgcccactgtctggcctgtgggtgtcaaatgtcccacctcttcaaatgtgcttggatcgatgatgagtcccccataaaaacattccttggaaaagctgaacaaaatgagtgagaactcataccgtcgttctcatcagaactgaggtccagcacgttgcctcccgtggggactgtaggagcgagggacaacttccactggttcccataggttccaccaccgaggacatccacaggccaaagtctcccatgaaatactcgttaggaacattccctctgtgtgaggtacatgggtgggagatttgtgggggcactggctgctctgtgatggcgtggcggccatggaagaggggagaaatgtcgtgggcctaggggagtgtgtggctggtctcagcttggtgagctttcaggaagggaggcctggacctcatgggtggcatctccatgcagaggacaaggtctcacttttgctaccaaggagagcacaaggtccaggcctcaggcagaccttgttcttgatttctggttagctgaggacagggaagtgccaagggtgatgagggagagtgtggagcaatgggtgccacggcagatggccaatggctcttcagccctcctgccaatgttggtcacagtgtccccccagcacggatttctttgcctcccgaaatgtaagatgcctgtggtttggtggtgaaggtgtaggcagggtggtattccagagaaaaggtgctagagggctctcgtggacatgagtgtgcattgggctttaatttggcagtgataggctttccatggatttctctggtggatgacaggtcagccagggtgggtctttgagggcatgtctctgggtgagtgagtgtgaggatggtgtccatggccctgggtcacttctgttgttcccagcagagtagggggctctactgttgtgcacatcttcctggaaatggtctcttggccttcgttgtcgggtggccccacctgctgctgctctcgtgagcaaatactgctctgtatcattcccgctttccatcccaaaagtgtccagagcgaatgtgccctgtccctggcctgggactctcctttgggctccagtcatgcatgaggctacccgtggagatctatgtgcattctgagcagtgtgtttgcaatcccaggggcattgccacagagagtcttgacttggcatgtctccatgtgactgtgtgctggcgatgttccagtgttggactccaaaagtccctaggcgtgataaagcatttcagctcccttagctggtttgaagtcacagagcaggcaggacagccatgccactttcaagggcatacagttggcacagaaaaattggaaaggattggtggtcgtacatcttgcagctcacttagtagctgcatgcatgtagaccgggtggtgttgatgcagtgttgacttgctggcattggggtgggtggtagcatggtcaagctggctgagtgatgggatattgtctcagaggttggtgcagggaaactctgtgggtgtgtctaatgcaaggataatgacaatgtcctgtctgcctggtctttggggggtcaggtggagatgtccttttggaaaggcagccattctctttgagtgtccagagggcatggtgcaggcacatggattgagtggagggaaggaagcgtgtgtcttgaggtcctttggctaggttgggaagactacctgtggccctgatgctgtttcagagtgatgtgctggccattgcaaaggcgccctccagtgctggttgtggttggttttccatcaggtgcacctcacctggtaaaggggccagagacagtgtctggtcatgacatcagatgctctgtgaggaggagcatgtgctcgtgccaggggtgctggctgttaggcaagggaccttggacctctttcctcatggccttgaggtcaaagttcacatcctattgattgaaggctggggtcttgagtctttggtttagtggggttggttccggtctggaggctgcagactatgactgcccgctggggtgttgggaaacacatgtgcattagggggacacacatccacacagagacacactcatgcacacatgtgtgcacagccacagacaaatagatgcagcaatgggtgtgtgcaatcgttaggccacacacacttataggtgtccatggagtgacacaggtaaggtatgaatgggtctttgaaggcatgtttctgggcgagtgagtgtcgggatggtgtccatggccctgggtcacttctggtcctcccagcagagtagtggtatgaatatggagatggaggtcagtcatagggtccaaggagaagcaggggtacgagttgccccgtgggaaagaatgacattgacgtggtgaccagtggacgtgggcctatttctcaagcgtgcatttgatttctttacacttttcaggggcagttgccttgagaggcccaccgcctgctggcatgacagatggtcagttcttccgagcagtggaatctccatggagtcgtggagtcggtgtggcctcgcatccacagtgcaccctgtgctggtggatggctcaggacagtaagcattcctctgccccgcatgatgagtgagggtgtctttagaatttctgagtcccacaaggaagtttttcagctggccattaagggcattgtcgaggcctttaaggtcatcagctcgcacactgcccagcctgcagtgtcaaatgtcctgcctctttgaatgtggttggatcgatgatgagtcctccaaaaaaaacattccttggaaaagctgaacaaaatgagtgaaaactcataccgtcattctcatcggaactgaggtccagcacattgcttcctctggggcctttactagtgagggacaacttccactagtccctataggttctaacacccatggcgttcacaggtgaaggtctcctgtcatattacaaacattccccccactcccctcccaaaaaaaggaacatttcctctgtgtcaggtacacaggtcagagagtcatagggtgactggctgctctgtgatggcatagtggccgtggaagtggatggaaatgtcgcaggcttaggggagtgtggggctggcctcggcttggtgagctcccaggaagggggacctggaaatcgctgcgggcatccttgcatagaggaccaggtacgtgttccagttctgctttcaaggagagcatgaggcccaggcctcagacagtccttggtcttgatctttggttagctgaggacaggggagtgccaagggtgataggggagagcgcacagcaatggatgttgtggcagacagctaaagcctttctgtccctcctttcacggtcagtcccagggggcccccagcacagacttttttcacctctcgagctgtgagattcctgtggtgttgtggccaagcctgggcaggaaggtaccccagagaaaaggttgtagagggctcacgtggacatgcatgccatcagtggtcttgggctgtcatttggtggtgatgggctttccagggatttctctggtggatgacaggttggccattgggggtcttcaagggcaggtcctagggagcatgagggtcgggctgatgcctgtggtcctgggtcactccattcttcctggcagagtagtagaagtgtccatcttcctggaaatggtctcttggcccgccattgccaggcggccccacctgctgcagctcgtgtgagcaaatactgctctggatcccatttcccgctttgaaagcagcttccatcccaaaggcgtccagagggaatgtgccctggccctggccctggcctgggactctccgatggggtccagtcacacttggcgtattcatggaggtccttgtgcattccaggcaacacatgtgcaataccaggggcactgccgtggagagtctcttgatttgggatgcctcctcgcctttgtgtgttggcgatgttccagtattggattctgctacatcctcagggcaatgaagcgtttcagctcacttagccggtttgacatcatagtgcagccaggacagccgtgccacattggcatggcacatagttgacttaggacagtcggaaagggttggtggttctatgtctcgcagctcacttcatagctgtttgcatgtaaacctggtgatggtgttgagatggtgttgacttgctgacgttggggtggttggtagtgcagttaagttggctgcatgatgggatgttgcctcagatgtcggtgcagcgaagccctgtaggtgtgtccaatgcaaggaaaatgaaaggtggtgtgtcctgtccaccttgtctttaggggttcaggcaggaatgtcctgttggaaaactagccattccctttgtgtgtcctgaaggcatggtgcgggcatgtgaactgattggaggaaggaagtgtgtgtcttgaggtcctttggctgggttcagaagactgtctctggccttgatgccgtgtgccgtgtttaagaccaacgtggtggccattgcaaaggtgccttccagtgcaagttttggttggtttggtgtcaggtgtgccttacctgggagagcggcgagagacagtgtctggtcacgacattatatgccccgtaaggaggactgtgtgcttgcaccgccaggggtgctggctgttagtcgagggacatcaggccaatgtctgtctgacccctaggtcaaaattcgcatcctactgattgaaggccttgggtctcgagccttttggttgcaggtgtggggatggtttccaggtctggaggctgccaactatgacaacccgttgtgctgttgggaaacatctgtgtgggggagacacatacacatagacacactcactctgacatacacacctacacatgcacaggcgtgcacagccacaggcagatagatgcagcaatgggtgtgtgctattgttgtggtcacatgtgcttcctaggtgtccacagagtgacatgggtcaggtatattcatgaagatggaggtctgtcatggagcccaaggagaagccggtgtgcaagtttccctgtgggaaagaatgggattgaagtggtgaccagtggacttgggcccgtttctcaagcatgcatttgatttctttacacttctcagcagcagttgtcatgagaggtctgccgcttgctggcaaggaagatggtcaattcttctgaccaacagaggctgccttgagtcctgatttggtgtggcctggcatctatggtgcacccaatgctggtgagtggctcagggtggtaagcattcctctgccctgtgtgcagaggtgtcttttgaattttgagacctgcaaagagctgtttctcagcaggccactaatggcatggcgagttccactcccagagctgattgtctgtgttcattgctcagtggtgtggctctgggttccccccaggatgctgaaggtgtttaaggtcatcagctctcccactgcccagcctgtggtgtcaaatgttctgcctcttcgaacgtgcttggatcgatgatgagtcccccataaaaacattccttggaaaagctgaacaaaatgagtgagaactcataccgtcgttctcatcagaactgaggtccagcacgttgcctcctctggggactgtaggagcgagggacaacttccactggttcccatgggttccaccacccagggcatttacagatgaaaatctcctatcacatgcatgtgaggaacatttcctctgtatgacatagacggatgggacagttgtggagggattggccactctgtgatgttgtggcagccacggaagcaggtggaagtgttttgacctagggttgtgtatggctggtctcggcttggtgagctcccaggaagggagacccgggcctcgcagcaggtgtctttatgtagaggaccaggtcacagttcccctgccaaggagagcatgaggctcaggcctcagatagaccttggtcttcattttccactagctgataatgggagttccaaggtgatggaggagagcacagagcaatgggtgtcaccgcagatggctaaagcctctttggccctccttccagcatcagtcacaggtgccccctggcatggatttctttgcatccctagccatgagatgaccatggtgcagtgaccaaggcttggccaggatggtaccccagagaaaaggtggtgaagggctcatgtggacatgtgtgtcatcagctgcattgggctgtcacttggtggtgatgggcttcccatggatttctctggtggatgacaggtcagccagggcgggtctttgagggcatgtctctgggcaagtgagtgtcgggatggtgtctgtggccctgggtcacttccggtcttctcagcagagtagtgggctccaccgttgtgcacacctttctggaaatggtctcttggcatgcattgttgggtggccttacctgctgcaactcatgtgagcaaataactgctctggatcctctttcccgcttggaaagcaatttccattctgaaggcatccagagggaatgtgccctggccctggcctgggattctccagtgggttccagtcatgcatggggctatccacggaggtctgtgtgcattccaggcaatgcgtatgcagtcccagcggcattgccacagagagtctctcgacttgggatgactctgcgtgttgacagtgttccagtgttggattccgctatgccctaggcgtggtgaagcatttcagctcccttaactggtttgaagtctcagcacggccaggacaggcatgtcacgctgaagggcacacagttggcttaggaaagctgaaaaggttggtagttctacggcttgcagttcacttagcagaaacgtgcttgtggaccccgtggtgttgagacagtgttgacttataggcactgtggtatgtagtagtgaggtcaagttggctgtgtgataggatgttgcctcagaggtcggtgcagggaagccctgtagatgtgtccagtgcaagaatgatgacaggcggtgtgtcctgtcaaccttgtccttagggggtcaagtggagatgtcctcttggaatagcagccattagctaggatgtcctgagggcacggtgtgggcatgtggactgagtggaggggaggaagcccgtgtcttgagattgtttggctaggttgggaagactgcctctggccttgacactgagtttcaaactgaggtgctggactttgcgatggtgccctccagtgctggttgtagttggttttccaccacatgtgcctcacctgagagggcagccagagagagtgtctggtcacaacatcagatgccctgtgaggaggagtgtgtgctcatgccaggcttggtggctgttaggcaagggacctcgggcccatgtccgcatggcctcaaggtcaaagttcacatcctactgattgaaggcctgggtcttgagcttttgggttgtgaggaggttcaggtctagaggctgcagactatgaccaccccttgtggtgttgggaaacatatgtgcatgagggagacacacatacacacacacacagacacactctctctctcacacacacacacacacacacacacaggcgtgcatagccacaggcaaatagattcagcaatgggcacatgctgtcgtttcggtcacacacgcttcctaggtctccacagagtgacacgggtcaggtatattcatggtaatggaagtcaatcatggaggccaaggaaaagtaggtgtgtgagttgccctgtaagcaagaatggcgttgaagaggtgaccagtggaccttggtctgtttcttaagcatgcatgtgatttctttacacttctaaggggcagttgccgtgggaggcctgccgtctgctgaaaggaagatggttgatgcttctgagcaatgaaggccccatggagtcctggattcggtgtggccttgcatccgtggtgcaccccgtgctggtggatggctcaggacggtaagcattcctctgccccgcatgatgactgagggtgtctttaggatttctgagacccacaaggagcagttcttcagcaggccattaagggcatggctgtggtctttaaagtcattggctcacccactgcccagcctgtggtgtcaaatgtcctgcctcttcaaatgtgcttggatcgatgatgagtcctccaaaaaaacattccttggaaaagctgaacaaaatgagtgagaactcataccgtcgttctcatcggaactgaggtccagcacatttgcctctgccggggactgtaggattgagggacaacttccactagttcccataggttccacctcccagggcatccacaggccaaagtctcccatcacacacaggttaggaacatttcctctgtgcgatgtagacgggtaagagagtcatgggcaaattgtctgctttgttatggtgtggcagccatggaagagtacagaaattttgcaggcctcaaggagtgtgtggctggcctcagcttggtgagctcccaggaagggagacccagatctcgcggcagatgtcactgcacacaggactgggtccgatttttttgccaaggagagcatgaggtgtgggcctcaggcagatctttgtcttgatttctggttacctgaggacaagggagtgccaagttgatggggaagagcaatgggtgtcccagcagatatccaaaggctctttggctctccttccagggttggtcacagggcctccctggcagggatttcttggcctcctgagctgtgagctgctcgtagtgcaatggcagaggcctgggcaggaaagtattccagagaaaaggtggtagagggctcacgtggacatgtgtgtcatcagtggtctggggctgtcatttggcagtgatgggcttcacatggatttctctggcagatgacagctcagccagcaggggtcattgagggcaggtcacagtgaacatgagggtcaggctggcacccacagcccttggtcacttctggtcttcacggcagagtagtgggctccactgttgtgcacatcttcctggaaatggtctcttggcccgccgttgccggatggccccacctgctgcagctcgtttgagcaaatagtgctctggatccactttcccacttggaaagcagcttccatcccgaaggcatccagagggaatgtgccttggctctggctctgccctgggcctctcccatgggctctagtcacacttggggctattcatgaaggtctgtgtgtattccagattccaggcaacatatgtgcaatcccaatggcattgccacagagaatcttttgacttgggatgcctccgtgccactgtatgatggcgatattcaagtgctggattctgctccatcctggggtgatgaagcgtttcagttcccttagccagtttgaagtcacagtgcagccaggacagccatgccacattgacgggcttgtggttggcttaggaaagttggaaaggattggtggttctacagctagcagctcacttagtagccacatgtatctacacctggtgctggtgttgaggtggtgttgacttgcaggcattgttgtgggtgggaatgcggtcaagctgactgcacgatgggacattgcctctgaggtcagtgcagggaagccctgtgaggtgaccagtgcaaggacaatgttaggtggtgtgtcttgtccactcggcttttggggcatcaggcgtggacgtcctgttggagaagcagccattctcttcaggcatcctgagggcacgtgtgcgtacgtggactgagtggagtggaggaagctgtttcttgaggtcgtttggctaggttgggaagaccacctctggctttgacgtcatgtatcagtgcaacattctgagcattgggcaggtgccttccagcacaggttttggttggttttccgccagatgtgccttacctgggagtgcagcaagagacagtgtctggtcccgacatcagaggccctgtgaggagtagcctgtattcgcgccaggggtgtggtggctgttacacgagggacatcaggcctatttccacgtggccttgagatcagagtgcacatcctactgattgaaggtcttgaacctttgatttgttggggggatcaggtctggaggctgcagactataaccgcccattgcagtgggaatctcacacacacacacacacacacacacacacacacgtgtgcacagccacaggcaaatactcgcagcaatgggcacatgaggttgttccaggcacacacacttcctatgtgtccacagagtgacagaggtaagatacattcatggagatggagatcaatcatggaggccaaggagaagcaggcatgcaagttgccccacaggtaagaatgggtttgaagtgaccagtggacctgggcccatttctcaagcatgcatttggtttctttacacttctcaggggcagttgccatgggaggcgcaggcctgctggaaggaagatggtcgattctcccaagcaacaaaggccacgtagagtcctggtttcagtgtggcctggtatccacagtgcaccccgtgctggtgggtggctcaggacggtaagcattcctctgcccttcgtgctgagtgagggtgtctttgggattcccaagacccacaatgaacagtttttcagtaggccactaatggcatgctgagttcctctcctagagtggatggtctgtaccttttgctcagtggcacagctctgggttccccagggtgccgaacatgtttaaggtcatcggctcacccactgcccagcctatgatgtcaaacatcctgcgtctttgaatgtgcttggatcgatgatgagtcccccataaaaacattccttggaaaagctgaacaaaatgagtgagaactcataccgtcgttctcatcggaactgaggtccagcacattgcctccactttggcttattgtggttcacgggtaactgtcatattacatggtacttcactacccaggcactggcattcaatttttgtggtcgttttgaccatagtaaaattctttatcataaatgtatttgagaatcatacttgggtagcccatgaatttttttagtgttactcttcttggtgtcaagttggtttcacccttaatgctaggttttggatttttgttgcatgattgatttttagccaggttctggtcaccaatcacagcctttcaccaacattcatggagaaagtttccttgttttttttatatgttgaggaagtacatatttcctgaatgtttttgcttttgttccaatgttgggctgactggcatgtcatctcttatcttatcttgaactgagtagtggtacaagtttttggctttcagcatccagggcaccaagtcttttgtacacaaattgcaagtattgaagccatggtgttgattgggatgctctacgcccatactctttagtggcatgacgccctcccagggtacccggaatccacatgtgcaactctgtatatgtgtttctgtgaacacagatatgtgaagccatagataagcagatttcatatgtaccacaggagtctatatgacatagccttcctgacctatgtacctgtctgtctttctgaagcacactcatttcctctgcaccttcctggtgtcattggcatggaaggaaggcccttgtccaagaaggatggtcttcgtcttgtgtgatctttgagatgccatgaggcccctggatacaaatggtgtgggctcctttggaggcttttggatttctcctgaatgtaagtgatttcttctgaaagcattctgattttcctcacttgcagggacaaagactatgtgtaggttgatgatgacttacatatatacgttttttttttttttttggaaaggtgaacaaaatgagtgaaaactcagtaccatcatcctcatctaactgaggtccagcacgcttctccatcagggcctagatttagggggccaacatctgtttgttatcatggtgtgcaccaaggcttaggatgtagttgtctttcagtgaaactgagtagctgagtattttgtactcccctggctgagagatacgtttgttgaacgacttacctgtgagaaggtggggtagcatcctgccagtgtgcaggagaaggtaaacctgcaggtgccacaggaaggcggtatccagttgcccacctctgcatggctgggtctgtccttgattcatacctcttgggttcgtcaccccccagaagaagacaatttattccacatgaggagacagcacggtgccattcctgagcacttcttcaactgtctttcatctgtggccggggacatgggacttcttatggtgtttgggtagcatcaagggctggccatcttgaagccagtggtgatgctgatttgctctctggaaaggagcctggagaagctctctacagtgaacttgtacatctataagtagaattccaaatttcatggcccaagaagggtagtggctgtgggaaggggagaggtctgtgtgtgcctttacctggcatcattccatgtgggtcgtggagtgatgactgtgaggctctttaagacattgcagggtgcccaaggtccatttcgtgatatcctcaggatggtttgcttgggagagcctgatgtcatttgcctctgaaccgctcagacatcttgatgcagttggggtttataagagtgtgtcattccccacatcgtggtgacttctacttggaaatgtgacctgcgaaggtctccttgcttatatacctcagcgtctcctgatattagggtattttcaaattcctcctaattcttcacagcagtcttctttgtgaaatagtcgttgtgtggtaggacagggctaccatccacaggccaatgatggataggtgttggactctgatgttatgttcacaggcaagtgccttaagatcttgttttcttagctgcagcaccttagaaatcttgtaggattcagaatgcctggtgctcttctgggtccctgatctgtacctgtgtagtgcacatggaggttgatttgtgatgtttctggatgggaagagtgtgaaggacccaaggggtaaaaatgcctcaaggccaaaggaaagttaacctttgcataggaagaggtttcccctccaaactctcctcactgaagtatcaccatagcctttgtcttctctgatggccaggagaagggtttttgagttggaggtgttataagagtggtgttgagagtgttcttcatgcttagtgctctctagttgatggtgccttcaaaattcatgcctgcctcctaccttcatgtttgggcaaacccatgcatgtgtgcagaaagaaggggagcccatgggaggtagatacagattactccacaacaggacaaatgacatgacccttgccacctatgcacctcactgcctttctcaagcacactgttttgcttctgcacttcttaggtggcgttggtatggaaggaaggccagtgaccgcaagggatgactttgatcttgggagatttttggagatggcaaagtgcttctaaacatgtttggcatggtctccttcaggctggtggatacctcaggatggtaagtattggttttccaaaggcacctaatgttccatgtttgcaggtatgaggactgtgcatggatcaatgatgacttccatacgtgggttccttggaaagttgaacaaaatgagtgaaaactttatactgtcatcctcttcaaactgaggtccagcacactgcttcaacaggggctagagatggaggtctacctctcattcattgacgtgggttgcaccaaggggtctgtccaggcttaggatggggttctcttttggcaaggggtagccccaggggagtgggagctcccatgcacaggagattcctggtgtgaaggacatctcttagtgaggccagggtagcacacacaccatcttcaagactaggtgaatgtgcaggtgacacaaaggacttaggctctgtgtcccccagtttgttcttgagtcttagttcttggttctctcatcatcgggaggaaggcaggtccttctcgttgggaagagaggacaagcctacacttttgcctcatttttggctcatttttatccttgtgtatgtacatagatttctggtcacctgcatgcttcacatccaggccagagtgcctctgttgtaccctctgtgttatgaagacatacagttggcctcctgccctaagctggggctgataggcaacgagtctctggcttatctcaaacctggtgtaggtcaaaggcttcctcgttaggggtgcaggtccccgaggcttttatgatcaactttgcaggtgtgcacgggtgtttaaagggatgctcaacatcagttctctctagtgggattatgtactccatgggctcccaggatccagacgtgcatccctgtgtctatgcagttctgcgtccataaacaggtgaagccagagatgggcagattgcagatgtactgcagggggccagatggcatggccctcataacctctgcacatgtctgcctttctcaaacatgcccatgtttcatctgtacctcccaggtggcgttggcatggaaggaaggactgtgtctgtgagggatgatcatcctctcatgtgatccttggagatgccaggaagccccttgacacatgtggcatgggctccttcagaggcttttggatccgtcgtgaatgtaagcaagcccttcccaaagccctgattttcctcatttgcagaaacaaagattgtgcctggatcaatgatgacttccatatatacattccttggaaagctgaataaaatgaatgaaaactctataccatcatcctcattgaactgaggtcccagcatgctgctacattggagggcaaggagagggggccaacatctgtttgttgacatggtctacaccttggcttaggatgtggtcctctttgggcaaatgcaagcgtctgggctttttggacttctgtagctgagagacagcttggttgaaggaatttcctctgagaaggtggggtaagcacactgccagcctgcagaacttgaagctgcagatggcacaggaagcagtagccagtagtctctttgtgcatgactgtgtgtgtccttgattcatagctttttggtttgtcgcctccccgcttgcacaggaataccattgctttcctttggggagagagcatgtcattcctggacacttgttcggcttactttcattctcagtcgaggatgtgggagttcccatggtacttgggtagcatcaggggcaggcagccatgaggtgggtggtgagctgatttgctttctgcagaggagcccagggagggtatccacattgaactcgtatgtccataggaggaaacccaagtcctttggtccctgcagtgtactggtggtgggaaggggagagggctgtgcatgcatgtaccaagcgacattccatgtgggtcgtggagcaatgactatgagcctcttttgggagttgtagggtgcccatgctccatttcatgatgaccttggggtgctgggatgggaatgagattgcaagtccctgtgttcctgccacttcgcagactgacttggtttgagagatctgtgttcaggaacccctgtgggatgcttgtctgtgttaggcatttgagcagatattggcccagggtttctacccttccatggttgtacatactgctggaagggcttgttgctccctctgtattgatgaggggaagttttgcccaggagagcctgatgccatttgcttctgaactgctcaggcacttcaatgcagttgaggttaagagtgtgtcacttcccatgtcgtggtagcatctactcagaaaagtgacccgtcaaggtctctgcacttaaattctccattatcttatgatgttaggttattttcaaattcctcctaattcttcacaacagtcctctttgtgaaacagtcatgaagttgtatgagggctgtcatccacaggccagtgatggagagttttgtactctgtggccatgttcacaggcaagtggcttaagacgtatcgtgttctcagggacagcaccatagaagccctgtaggattcagcatgtctgatgcttttctggttccctgagctgcacctgtgaggaaggccagaggtggaggttgatgtgtgattgaatgtgtttctcaatgcaaagtgtgtggaaggagcttcaaggccgaaggaaagttgttctttgtgctggaacactttttccctgcagctctccccattgaaatatcctcatggctgttgtcttctctgatggccaagagaatggcttttgagtcaggggtggtgaaagtgtggtattgagagaattcttcgcgcttagtgttctctagtttgatggtgcccttgaaatgcatgcctgccttataccttcatgcctgggtatatctgtgcataagtccccaaagagaggtcacccatgggaggtagatatagaatacagcatggcaggaggaatggcatggcccttgcaaactgtgtacctgcctgcctttctcaagcacacctgtttttcctctgcacttcccaggtggcatgggcatgcaaagaaagacagaggctgcaagggataaacttcatcttgggagatccctggagatggcagggaacccatggacacatgtggcatgggctcctttgggtgccggtggatcccttcatacggtatgtgttcatttctcaaaagaccctaatgttcttcctttacaggaatgaatactgtgcatggaccaatgatgacttccatacatgcattccttggaaagctgaacaaaatgagtgggaactctgtactatcatcttagttgaactgaggtccaccgggggctatagagggacaactgtcattttttttgatgcccgttgcatgaagcattcttccaggcttaggaagggattccgtttgggtgaaggagagtcacaggggagttgaggctatgtgcacaggacttctgtctacaaggctggggtagcacacatgcagtccgtgggactaggtgaatgtgcaggttgctcagggagagttaacctgtagcctgcctctgggtggccaagattgtccttgactcctggctctgggttcccacaacccctggaggaagacaagtaattgtgcttgggaagagagaacaaggccatacttttgcctttctttttttcattcttagtttgagaacagtggagttccaatcacctggcatagctttcatgttgtgttccatgcattgtgagtacatgcatatggcaggaacacacaggttcccactgcaagctgagcctgataggcaaggagtctctagcttaaccccagcccagtgtacgtcaatggcttcctcattaaaattgcatggccctgtagcttttgtgagtgacattataggtatcgatgtaagggtgttgagagggatgctcaatgtcagtgctctttagtgtgctgatgcactactacaagggcacctgagcccttgtccatgcatttctgtgtccaaaatcaggtaaagccagagttgggtatcaaccagatacactgcaggggatcagaggacatggcctttgtgtactgcacatctgtcagattttctcaagcacacccgtgtttcctcttcacctcccacgtggaagtgatgaattggccaggaccatgttggtgagggacaatcatcatctcatgttaacctcagagaagccaggaagctcctggacacacatggtgtaggcttccttggaggctgttggatctctcctgaatgtaagcaattccttcccagtgcaccctgattttcctcatttgcagaaacaaagattgtgtgtggatcgatgatgacttccatatatacattccttggaaagctgaacaaaatgagtgaaaactctataccgtcattctcgtcgaactgaggtccagcacattactccaacaggggctagacagagagggccaacattgattcgttgacatgggtggcaccaaggggaccatccaggcttaggatggggtttctttgggtgaatggtagacacaggggagtaggatctcccatgcacaggacataccttgtttgaaggacttctgtgtcctagggctggataactcatgtgctgtctggaggactaggtgaatggcagattgcatgggaagagttaactggtagcctgcctctgatggccaagtttgtccttgagtccaagctctgggtaccgaagtcccccagaggaagacagatccttctggttgcggggagagcaaaaggctacacctttgccattagttggctcattttatccttagctgaggatgttggagttgtgtttacccggcatagcctctgtgcctatgtgcccatgttgtgtactgtgcattgtgaggatgtatatttggcatgaacaggcaggcttcctctccaaactggggctgatagacagcgaggctctgggttatcccaaaccagatacaggtcaatggcttcctctttaggggtgcagggccttgattattttgtgactggcattgcaggtgttgaaacaagggtattgagaaggatgctcaacatcagtgctctttagcgggatgatgcattctgagggctgccatccccaagatgagcatacttgtgtccataaatttctgggttcacgaacaagggaagccagagacaggcatattccagataaaccacagggggaagatagcatggtcctcgtgacctgtgcacccgtctgcctttctgaagcatgcttctttatcctctgcacttcgcaggtagtgttggtgtaaaaggcaaacccgtgtcatgagggatggtcatcatcttgtgtgatccttggagatggcaggaagccctggacatacatggtgtgggggctcctccagaggctgttgggatcctcctggatgtaagtgattccatttcaaagcaccctgagtttcctcatttgcagggatggagattgtgtgtggatcgatgatgacttccatatatacattccttggaaagctgaacaaaatgagtgaaaactctataccgtcatcctcgtcaaactgaggtccagcacactgctccatcaggggctcgagagagaggaacaacatccatttgttgacacagactgcaccaaggcttggggtggggtctttttctggcagaggagagtagctgggaattttggacgtttgtaactaagagacagcttggttgaaggcagccaggtgtgtcgtcaatttgtaccttgggtcccttgtcctccagaggaagactattgcttccacatggggagacagcacaaggtcattcccagacacctctttcactcactttcatccttgtcaagggacgtaggacttcccatggtgtttggatagcatcaggggcaggcaggcagtcttcaggaggatggcgatgctgatttgctttctgcagaggagcccagagagggtatccacactgaacttgtatgtccataggaggaaacccaaaccgcatggtcccagaagggtcctggtggttagaaggggagaaagctgcacatgcatttaccacacagtcttctgtctgggttgtggagagatgactgtgagcctcttttgggtgttatagggtgcatacggtttattttatgatgatcttgggatgctgggatgggaatgtaattgcgaatccatgtgttcccgcaactccacagacttgacttggtttggcaggtttgtgttcaggccctctgtggaatgcttgtcttcattaagaatttgagatggggctgggcacggtggctcacaccttctgggtgcttgagctgcacctgtgagaaagaccccgaggtggaggctgaattgtgattgagcatgtttcttgaatgtgaagtgtgttgatggatgcttgcagtaaaaatgcttcaaggctaaaggaaaattgccctatgcacaggaagagttttttttttcccaaaactctccccattcaaatatctctatggtctctgtcttctctgatggccaagggaagggcttttgagtcggggcaccaaatgagtggtgtccagagttcttcacatttagtgctctgaagcttgctggtgccctcaaaatgtatgtgtgcctcaaaccttcatgcatgggtactcccatgcacacatcctgaaatgggtatcccatgggaagtagcgatagggtatcccacagggggttgaatggcatggcccttgtgacctatgtgtttgcctgcctttctcaagcacacccgtgttgcctctgtacttcctaggtggtgtgggcatggaaggaaggccagtggagacaatggatgatcttgttcttagcagatcactggatgtggcagggagtcctaggacatgtgtggtgtgggcttcttcaggtgctggtaagtatctattccccaaaaccccctaatgttactcctttgtgggcatgaagactgtgcatggatcgatgatgactttcatacatgcattccttggaaagctgaacaaaatgagtgaaaactctataccgtcatcctcgtcgaactgaggtccagcacattgctcttacaggggctggagtgagggccaagtttcatttgttgctgcaggttgcaccaaggggtttgttcagttgtaggaggggctccctttctgcaaggggtagtcacagggttgtgagatctctcataaataggaaattgttttagggacttctctctgcaaggtaacacacacacaccgtctgtaggactatgtgaatgtgaaggtgacatgggaagacttagcctgtagcctgcctctggtggccatatttgtccttgagtcttagctctgggttccatcattcccttgaggaaagacaggtgtttgtgcttgggaagagagcacaaagccccacctttgctgttttttccactcattttcatcattgttcaaggacattgcagttccggttttatccataaccagggaagccagagacaggcagatagcagatatgccatagggggccagatgacacggccctcatgacctgtgaatgtgtctgcttttttgaagcacactcgtatttccgctgcacttcccaggtggtgttggcatgaggaaaggaggtatcttcgagggacaatcttcttcttgtgcgatccttggagatgccatgaggcccctggacacatgtggtgtgggctcctttggaggctgttgtatcccttctgaatgtaagtgtccactttccaaagtcctgattttcctcatttttgggcatgaataatgtgcatggatcgatgatgacttccatatatacattccttggaaagctgaacaaaatgagtgaaaactctataccgtcatcctcgtcgaactgaggtccagcacactgttcatcaggggctagagagagagacaacatccatttgttgacacaggctgcatcaatgcttgggatgggatcgtctttgggtgaagtggagtagctgggcattttggacttctgtggctgagagacagcttggttgaagctcttccctctgtgtggctatgtgtgttatcgattcataccccttggctcctgcactccccagaggaagacagttactgctgcatggggacacagcacaatgttgttcccaggcacttcttcggctcacttttatcctaagtcggggacatgggagttcctgtggtgtatgggtatcatcaagggcaggcagtcgtgaggagggtggcaatactgatttgctttctgcagagaagcccagagagggtatccacgttgaattgtatgtccataggagggggaaacccaagtcccgtggcccctgaagcatcctggcagtggaaggggagagggccgtgcatgcgtgtaccacacagccttctgtctgggtcacagagcgacgactgtgagcctctttcgggcattgtagggtgcccatagtccatttcatgatgacctcagggtgctgggatgggaatgtaattgtaggtccacgtgctcctgcatctctgcagactgacttggtttggaaggtctgtgttgaggaacctctgtgggatacttttccttggtgcatttgaggtgtctgataatgagtgtgtgggtttctgtatcctggtgacttctactcagaaatgtgacccagcaaggtctctgtgcttaaataccttagtggcttgtgatgttaggttattttcaaattcctcctaattgtgtgtgacaattcacacaagtctttgtgaaattgtccttgaattgtatgacagggctagtgtctgtaggccagtgatggataagttttggactccacagccatgttcacagccaagtggcttaagatgtatggtgttcttagtcatagtgccttggaagccctgtaggattcagcatgtcttgtgctcttctgggtccccgagctgtacctttgaggaaaacccagaggtggaggttgatttgtgattgagcatgtttctcagtgggaagagtgtcaaaggagcctggggtgaaagtacttcaggaccaaaggaaaattgcccttcactcaagaagaggctttccttgaacctgtccccactgaaatatcctcatgggcttcatcttctctgatggccaaaagcaggacttttgattcagaggtggcaaatgaatggtgttgagagagtttgttatgcttggtgctctgtagctggaaggagccctcaaaattattgtgtgcatgatagcttcatgcctgcttacacccatgcacatgtcccagtaagaggggctgcctgtgggagatacatacacgatacaccacagtgggatgaattgtatggcccttgcaatgtgtgtacctgcctgctgttgtcaaacacacctgtttttcctctgaactttccaggtggcgtgggcatagaaggaaggccagtggccacgagggacaatcttggtcttgggagatcctggaaatgatagggagtcccttgatatgtgtggcatgggctccttcaggtgctagtggattccttaggatggtaagtgtccatttctcagaagctccagatattcctcctctgcagggacaaagactgtgcctggatcgatgatgacttccttatatacattccttggaaagctgaacaaaatgagtgaaaactctataccgtcatcctcgtcgaactgaggtccagcacattgctcttacaggggctagagagagagggacaaatttcatttgatgatgcccattgcaccaaggggttctgtccaggcttaggatggggtctcgtttgggcaaaggagaatggcaggggagtggaggctatgtacacaggagattccttgtttgaaggactctatttgtgaggccagggtaccacacatgctgtccgcaggagtaggtgaatgtgcagttgcccaggaagagttagcctgtagcctgcctctgcatggcagtttgtccttgggtcctggctctggatttccatgttccttggaggaggataggtgattttgcttgagaagacagcacagtaccatacttttgttgtttttctgctcatttcatcgtccattgaggacaatgaagttgtggtcagcaggcatagctttcaggccagcgtgcccatgttgtgtcccatgcattgtgagcacatgcatgtggcatgaacacataggctgccactccaagctgagtctgataggcaatgagactctggcttatcctgatcccggtgtagatcaaagtcttcccagtaggattgcatggccccgaggctattgtgagctgcattgcaggtgtggaagcaagggtgttgagagggatgctcaacattagtgctctttagcgagatgatgcactataagggcaccctgaacccagacgtgcatccctatgtacgtgcatttctgtgtccataaatagttgaagccagacagccagattccagatgtatcgcagggggctggatgacatggcccttgtcacctgtgtacctgtctgcctttctgaagcacgcttgtgtttcctctacacctcccaggtagcattggcatggaaggcaggcccatgttggtgagggacaattgttatcttgtgtgagccgcagggataccaggaaacccctggacacaaatggcaaaggcttctttggaagttgttggatcccttctgcatgtaagcagttctttcccagagcgctctgattttcctcatttgcagggacaaacactgtgcgtggatcgatgatgacttccatatatacattccttggaaagctgaacaaaatgagtgaaaactctataccgtcatcctcgtcgaactgaggtccagcacattactccatcaggggctagacagagagggccaacattcgtttgttgatatgggttgcatcaaggggtccatccaggcttaggatggggtccctttgggcaattggaagtcacagggaagtgggagctcccatgcacaggaaattccttatttgaaggacttctttctccctgggcgggataactcacctactgtctgaaggactaggtgaatggcaggtggcatggaaagagtttgtgggtagtctgcctctggtggccaagtttgttcttgagtccaagctctggattcccagaggaagacagatcccctggttgcggggagagcacaagcctacactattctcacttgttagcttgttttgtccttggcggaggacgttgtatttccaggcacccagcatagcctctttgccgcatttccatgtcatatcccatatgttatgaggatttgtgtattgcatgatcaggcaggcttctgctccaagctggggctgtcaggcaaggagtctctgggttattccaaacctgatttaggtcagtggcttcctctttcaggattcatggccccaaggcttttgtgagcaccattgcaggtgttgaagcaacgatgttgagagggatgcccaacatcagtgctctttagcaggatggtgcacctcgagggcccctggccctgggacgagcatctgcgtgtccatgcatttctgtgtccatgaacaggcgaggccatagacaggcaaatagcagatgtgtcacaggggactggataacatggccctcgtgacgtgtgcaacctgtctgcctttctgaagcacgcctgtgtttcctctgcacttcacaggtggtgttggcatgaaaggcaggcttgtatcatgaggaatgattgtcatcttgtctgattcttggagatggcaggaagcccctggaaacacatggtgtggactctttcacaggctgttgaaaccctcctgaatgtaagtgatttcattccaaagcaccctgagtttcctcatttgcagggatgaaacctgtgtgtggatcgatgatgacttccatatatacattccttggaaagctgaacaaaatgagtgaaaactctatactgtcatcctcgtcgaactgaggtccagcacattactccaacaggggctagacagagaaggccaacatccgtttgttgacatgggttatatcaaggcgtctgttcaggcttagaatgtggtctcttatgggtgatgggggtcacaggagagtggtggctcccatgtataggaaatttcttgtttgaaggactgtcagtgagggtgggtaacacatgcattgtctgcaggactaggtgaatgtccatgtggcctagcaagagttagctggtagcccgcctctggttgccaatttgttcttgagtccttgttctgggttctcaggtcccacggaggaaaacagatctgtgtggttgagaggtgggtacaaggccgcatctttgtcatttgttggctaactttgtccttggttgaggacattagagttttggtcaccaggcatagcctatgtgcctttgtgcccgtgttgtatcccacgtgttttgaggacatgtattttgcacgtaaaggtgagctcctgctccaagctggttctgataccaaaggagtccctggcttatcctaaactcatggtaggttaaagccttcctccttaggggttcagggccgcaaggcttttgtgagtggcattgcaggcgttgaagcagtgatgttgagagggatggtcaatgtcagtgctctttagcaggatggtgtactgcaggggcccccagccccgagacgagcatccctgcatccatgcatttctgcctccatgaacaggggaggccagagacaggcagatagtagataaattgcaggggactggatgacatggccctcgtgacctgtgcacctgtctgtctttctgaagcacgcctgtgttaactctgcacctcccaggtagcactggcatggagggcaggcacatgttggtgagggacaattgttaccttgtgtgagctgcggagataccaggaagcccctggacacaaatggcaaaggctccttcggaagttgttggatcccttctgaatgtaagcacttctttcccagagcactctgagtttcctcatttgcagggacaaatactgtgcgtggatcgatgatgacttccacatatacattccttggaaagctgaacaaaatgagtgaaaactctataccgtcatcctcgtcgaactgaggtccagcacattactccaacaggggctagacagagagggccaacatctgttttttgacatgggttataccaaggcatccgttcaggcttaggatggggtcttttatgggtgatgggggtcacaggagagtggtggctcccatgtataggaaatttcttgtttgaaggactgtcagtgagggtgggtaacacatgcattgtctgcaggactaggtgaatgtccatgtggcctagcaagagttagctggtagcccgcctctggttgccaatttgttcttgagtccttgttctgagttcctggaaggaaacagatttgtctggttgggaggagaatacaaggccacatctttgtcgtttgttggctaactttgtccttggttgaggacattagagttttggtcaccaggcatagcctatgtgcctgtgtgcccgtgttgtatcccatgtgtttgggggacatgtacattgcatgaactagtgagctcctgctcattgcttctgatacccaaggagtccctggcttatcctaaacccaatataggttaaagcctttctcattaggggcccagggtcccaaggcttttgtgagtatcattgtaggtattgaagcaacgatgttgagaaggatgctgaacatgctctttagtgggatgacgtactctgaaggctcctgacccccagatgagcatccttgtgtccgttaacttctgtgtttatgaacaggtgaggccagagacaggcagacagcagatgtattgcagggagctggatgacatggcccttggaacctgtgcacatgcctgcctttctgatgcacgtccatgttttctctgcacctccccggtggtgttggtataaaaagcaggcttacatcagcaagggatgattgtcgtctcatgcgatcctgggagatggcagaagtcccgggacacatggagtgtgggctctttcggaggctgttggatccctcctgaatgtaagtgattccttcttaaagcatgctgattttcctcatttgcaggggcaaggactggatcgatgatgacttccatatgtacattccttggaaagctgaacaaaatgagtgaaaactctataccgtcatcctcgtcgaactgaggtccagcatactgctcatcaggggctagagagagggacaacatccgtttgttgacaagggctgtgtcaacacttgggatggggtcgtctttgggtgaagtggagtagctgggcattttggacttctgtggctgagagacagcttagttgaagcacttccctctgcgcagctatgtgtgtccttgattcaaactccttggctcctgcactccccagaggaagacagtggcttctgcatggggacaccacacaatgttgttcctgtgcacttctttggttcactttcaccctcatttggggacgtggcagttcccatggtgtttaggtagcattgagggcaggcagtcctcaggaggatgttgatgctgatttgctttctgcagaggagccagagagggtatccatgttgaacttgtatatccataggaggaaaccagtcccatggcccctgaagggtcctggcagtgggaaggggagaggtctgcatgtgcatgtactggacagcatattccatgtgggtcatggagtgatgactgtgggcctctttcgggcattgtagcaggcccccatttcatttcatgatgacctcggggtgctgggacaggaatgtgattgcgggtccacgtgcttctgcaactcctcagactgacttggtttggaaggtctgtgttcaggaccctctgtgagatgcttgtctccattaggcatttgagcttatatcggcccagggtttctacctatcgtaggttgtgcatactttgcctctgaaccactcaggcacctcgatgcagtcaacgtgcccgattataagagtgtgacttcccatatcctggtgatctctactcggaaacatggtccaggaaggtctctgtgcttaaataccttagtagctcgtgatgttaggttattttctaattcctcctaattcttcccaggagtcttctttgtgaaatagtcatcttgttgtaggacagggctggtatccacaggcagtgatgcataggttttgcactgcgcggccatgttcaaaggcaagtgccttaaaatgtatggtgttctcagccacagtgccttagaagccatgtgggattcagtgtgtctggtggtcctctgagctgcacctgtgaggaagacgctgaggtagaggttaagttgttattgaacgtttttctcaatctgaaaagtgttcaagcagcccagggtgaaaagtcttcaagactgaaggaaaattgccttttgtactggaagagtttttccccaaaactctcctcatttaaatagccctgtggcttgtgtcttctctgatgaccaagaggagggcttttgagtcagtgatggcaaatgagtggttttgagagagttcttacacttagggctctgtagcttgatggtgccttcaaaattaacacgtgcctgctatcttcattcctgggtagacccatacacccatcccaaaaggggagtagcctgtgggaagcacatatgggatataccacagtgagtcgagtggaatggcccttttgacatgtgtacctgcctcccgttcttaagcacacccgtttttcctctgcacttcccaggtgttgtggccatggaagtaaggccagtggctacgagggacagtcttcatcttgggagatccctagagagggcagggagccccttgacatgtggaatgtgatctctgttgggtgctggtggatcccacaggttggtaaatgtccattttccaaaagcccctgatgttccttctttgcagggataaagactgtgcatggatcgatgatgacctcaatacatgcattccttggaaagctgaacaaaatgagtgaaaactctataccgtcgtcctcgtcaaactgaggtccagcacgtggctccaactggagctggagagagagagacaacttccattggttgatgtgggttgcactaagccatccatccaggcttaggatggggtccactttggatcaaagggagtcacagggcagtaggtgctcctgtgcagaggagattccttgtgtgaaggacttctctttgtgaggctgggtagcacgcacaatgtctgcaggactgggtgaatgtgcaggtggcacagaagagttagccggtaacccgcctctgtgtggccaggtttgtccttgagtgctggctctgggttcccttgttccccagaggtagatagctccttgtggttgggaagagagcccaaggccacatctttgttgttctttggctcattttttttcatggctgaggactttttagtgcccatggtgttttcgtagcagcagtggaagtcagttgtgaggaggttggtgatgcttattttctttctggagagtaccctgtagatcggctccatttatgatttgtgtgtctccagggagaaactgaaatcccatggctggtgatggatactccaggtgggaatgagaaagcgccatacatgtgttgacttggtaccctaagatggggatggtccgccacatttgcgcgtctgttttgcatggtgtgtactgcacatcacaaatgccatgttggccttagggtgctgggaatggaatatgatctgatgtctacatgggagggcctttcagcagattgcttttgtttcctgacagtctttgctccatccccagtcacacgtgtttttctccagggaacattttattggagtatatcaggtcgatatcagaaaaaaaaatgttgtggttatcccaacattaagtgtggtgatgtaacagcagtgtggatggtagctcaagtgaacagtggcaaaaccaaaatatattggtttacgtaagtgaccctattctctcctatgtttgaagtctggtatgcatctctttctgcaataatctcagtgatctggaaactttcaggaggtcttttttagatattttatgtccttgtggttgtactcatactccctgcagtgctaagtctgagtcattctgctatcctagtgctactggaatttctattgttttgggggcactgtctggtcattgtggatacctctcttggggccctttaataagaagtatgttagaggtcggttttggggcagtgttgacctcctgcctaaggtcaaaggcagttttcttcctaaatcttattgcaggattcactgcctgggggttgtgtgacagggagagcacaaaattagggtatcccatgtggacttgtgtccagtatcaaggcagtgttggataattttctatatccacaaggctcccactggactctttatgtccagcagacattcacaggccaacttttctcttacacagggggcctcattcctgccatgtgtagcttccatggaaccatccttcaggttttaagtgcaaggatttctctcaagagtttaatttgtttctttaagacaccgttttcttttctataaattctgctttctgtggtttgtagcacagatgaaattgccaggtcatattctacatttctgcccaatcttggattagtgagcctttgaaatatgttccttgatcactggcaatggttcttggaataccagaacttagttacaagcattgcagacctacagaggtttgttgttatttttaactgcatgaagcagtgggtttgtttgtatcttgtcactcacggctgtcagcaaaacttaggtgttgctaaaccagaccacacccatgaattatagtgcctctggttccttctgtagtagcctgtgggaagtagatacaggatgcaccacaagggaatgaatggcatggcccttgagacctgtgtacctgcttgcctttctcaagcacacctgttttgcctctaattcctaggtggtctggcatggaagaaggccagaggctgcgatggatcatctttgtcttgggagattcctggagatggtggggagcccctgggcacgtgcagcatatgtggcgtgggcttcttcaggtgctggtggatccctcaggatggtaaatgtccattttccaaaatcttctgatattccatctttgtaggtacaaagactgtgcatggatcgatgatgacttttatacatgcattccttggaaagctgaacaaaatgagtgaaaactctataccgtcatcttcgttgaactgaggtccagcacattgctccaacagtgggtagatagagagggaaaacttccatttgttgacgcaggttccattgaggggtttgtccaggcttaggatggggtcccctttgggcaaagggagtcacaggggagtgcggcctcctgtgcacaggagattccttgtgtgaaggatttacctctgtgagagcagggtagcacacataactatgcaggagcaggtgaatgtgcaggtggcacaggaagagttagatggcagcctgtctctgcacagcgaggtttgacttgtcctagctctgcattccctcatcccttagaggaagttggtttcttcagaagacttaaatttgtggaattcagtagaatattatccacataatgttcccagtgaatgctaggcatatcacccaagatggccaggcctctggccataaaccatagtaaatagtagggtgtgcatatatccattagggagaacctgaaaggtccttttttggccctccaaggtgaatgcctgcaaaagcaagcgaagcacgctatctgcctgcatgagccccatgtacctggcgtggcctgtgctcctcaccgtgtgtcccacttctgctgccccttcgccttgccaggtggagtctgactgattttttgccactgctgccaccacaggccacctggagccccagccagtttgaggaaagtggctctgcttgattttccttttttctttttttttcctctttttttctccatttctgacttcagcaggtgggacttggagcttctgcttctgcagccacagaagactccccagtttggagggctgtggttgtgggctccctaagcatctctctgcagagcctctttgttttccattttacccaccatgtcaataatttaacacagtggcggaggagttcatgtctcttcctatttgtcattactcttctaactttcacagctgtactcggctactggtcagaataagagaaaaagcagtggaaccaggaggatcctacaagaaatattccatttcacttttgtttgtgcatataccttttctgtttaaatgtggacttcgatttgatatgcttccagtgcagacacagatcccatatgtaagagagtatggagttgcatagaaagaagacttgtcattttcctgtactgttggtgttctaatctgtcttcgtggtttttgcctcttctggctttagaagatacaccaacatggttttgcaacatagcctcttcttattttagtaagggaccaaatgtgcatgtcagtaacaggtgttaccttgaattgggatcagtgcttgtgtgactatattcagtgatgtcattttctgtcacactcaagtcacaaaatatttaaccacttatttttttatctctggaggaataatccaaaagattgtactggtaaagccagaacaatttccaattatgctaattatttgtataatacttagttggctttatctgtggtttgttggcttattttcctgtagcttttcaaggtttttctatgagttctgttaaagagtctgaaaatggagcgtagaagacatgcttcgatttccaggatggttgtgttttccagagaggcggaggtaaaccactggcgcagccctgcctcccacagataattccgggtgcagtgtttcatatctagacttggacttctatcctaccatacttctttgtgtgcaggtatttttggggataaaatccttgttttcagctgtatagatgtcttgcacatactcttttgatggtttgatttatccattgtgttcagcacgtttcagtgagcaagatatgggatttaatttccaatataaaatccatgactgctggccgggcgcagtggcttatgcctgtaatcccagcactttgggaggccatggtgggcagatcacgaggtcaggagttcaagatcatcctggccaacatggcaaaaccccatctctactaaaaatacaaaaattacccatgcgtggtgttgtgtgcctatagtcccagttactcaggaggctgaggcaagagaatcccctgatcctgggaggtggaggttgcagtgagctaagatcatgtcactgtattccagcctgggcgatagagactctggctcaaaaaaaaaaaaaaaaagaatgttataattattttcagcctcatgtctccgtgtcacacacaggtccatgaagctgtgttctttttttttttttttttttttttttcagagtattttctttcttgtccagattagctaaattggattgttctatgctaaattcacttaatcactactctattatttttgaattttttagttctgtttttttcacttggttctttttttaaaaaaacttctactacctttctgagacttctacttttttacttttttcaagaagctttataattacttgctaaagcatttttaccatgactgtttttaacttcttcagataaccacaacatttggttaatcttgaggttggcttggttaactgtcttttctcatcctgcttatgattttccttctaattgtgatttttccggttcttgatagatgggtgatgttttagtttatcctgcatttttttttcctttttaagttagaggaatctgaatctattcaaatgttttattttagcaggcatgtgccctgtttaggtttaatttgaatgtcctgtcctacttttgtaggccatgttttcgcaggcagtcttgctatcagagctgaggggatgctgttttgatcacttagtttatctgatgttgctgggcctccaactggtgctgactggtacttcctgagatggcgaaggtttttctgtactctgagatgccgtgtatctctatgtaaggggaggagactctggaccacaggaatgaagagaacatcttaggtcaggcagctcaatcatatgcgataacctgggtcaaccagccagtagcctcatgaagtatgggagggaattctccagtgtcagcattcaaagacatcatgagtttttacttctcattttcttttaagtgaaataatcgcatggaaattaaagaataaatatatgaaatatatgaaacttatatgaaatataagaatgtgagaaggcctacagcgtggggatccccaggctatttgaacaatgaatgtctgtgttacacatctttgctcactttttctctatttttgtagttcattgtggaaccagcacagattttcatacgaaagttatttctttttaacctcaaaaagtgacagaatggagtgtatcatgaaaaagtctgacatcaaaacctcaaaatgtgatattggtaagcattttgtcctgagaataccagcatttcctcttaggggatcatgacactgcagtgaccatgtgaccctggctgtgctagtcagcctgggctgttcattgactgtgatgctggtctccatgtgattgactagtgtgggtcagtgcctccaaaggtgacagctgtgtgctcagtgtctgccacatatctcaggctcaaggtcccttttataaatgtgcctggatcgatgatgactttaaaatggatctcatcggaatctgaacaaaatgagtgaccaaatcacttctgtgccacttctgtgagctgaggtccagcacaggggccatgccagacaaacacatggagggtgttttgtttggtcagcactggtactatgaaacggcctgtggaattagacaactaaccagctcacatacagtacaggaaattactggacagttaacctaccaatatatggttgggggtaagacggagacttttcaaatgcttggctggtagcatctgtacactacagtgaccagacactgggagccagcacaggagttataggatttacaggaaattattgtgtgaacccacaagccattcagacatttgtgtgagcgcccagaatattctggttgatggtttgttgcttgatggcaaagagatgtcagcattcaaagacatcatgagtttttacttctccttttcttttaagtgaaataattgcatggaaattaaagaataaatatcttatatgaaatatatgaaacatatgaaatataagatatttatttatatcatataagatataaatatctcatatgaaatcttgtagtatattttcatttgattgccaacccagtcactaggactgaaacagttgtttattttttgttttcccatcaaccaagcaagctatttaatacatgtttcagtgctggtttcaactacatgttgcagcaaacatttttagaagtgatatttcaaattcttggattttcacatggatttcattgtctactttcatatgtcctccatgtgtgaccactgtattaattaaaagttgtaataaatgattttgaaaggtatgtgctggaggaacttcgggacaaatgttttagaaaacattatttccataaaatttggatcaaagatgtgagcataattgttcttgttatacagatggtccaatgagtgtctaatgtgaattcttataactgtttataacaaagtagtccatgaagcaaattttgtttcacaactttcctaatttcccctgtactctgtagattgggtgagatagaattccatggaatttcattgccaaaccagtgaagtgctaattttgacatttgtaccagctaacgtagctgtgaagaaacacaccaatacacttctaaggtaacattcaatttttagtgaatttatttttgtgagttatttttattcttttaagtaatcaagaatttatgttcacaaggaattggttaatactaacagtttcagacattaatgttctgatgagctgaggcatcaatctccttttgataaaggttttgttcttttctctactttgaataacatatgaaatgtccaacagcagttctaagttagtgtatattccatatatgttaatagtgaaacatcctgtcttatgcaaggctaaaaattgtccgtgtatacttctcagatttgtatacatactctcttcctacaggacagcatagaccaagatctaggtttcatatggatgaatttattcttccctttgaggcaagacaagaaggaaagaaagtattgggaataatgctgccctcccatcctcaagggccagtgggaactctaatattggtaagccttttgtcctgaaaataccagcatttcctcttagggaatcataacactctgctaaccgtgagactctggctatgctagtccgccatgggctggtcattgactgtgatcctggtctccatgattgaatagtgtgggtcagtgtgtcccagagtgacagatgtgctcagtgtctgccacatatctcagactcaaggtcccttttataaatgtgcctggatcgatgatgactataaaaaaaatggatctcatcggaatctgaacaaaatgagtgaccaaatcatttctgtgccacttctgtgagctgaggtccagcactgggaccatgccaggcaaacatgaggagggagtttacagggactagggtattggaaaactaacctacccatatatattagagcaaatgaattgttctcagttctgtaaatatccagctgtggtttgacatagcaactctctttgtatttgcttggcagcatttatagaaacagctggtagaccctggggaaccagggcatagtgagattcatgggacgttatttcacctactcttgagccattcacacatttgagctcgcagaattatctggtcaatgagcagtctcttgagggtaatgagatggtcaacatccaaatccaaagatactaatgagattttacttttttttttgagatggagtctcattctgttgcccaggctggagtgcagtggcataatctcggctcactgcaacctccacctcctgggttcaagagattctcccgccccagcatcctgagtagctgggattacaggcgcccgccaccacccctggctaatttttgtgtttgtagtagagatggagtttcaccatattggccaagctggtctcgaactcccaacctcaggtgatccagccactgcagcctctcaaagtgttgggattacaggcatgagccgccgtgcccggccttactttttattttcaattaagtgaaacaattacatggaaattgaaaaaaaaaaaaggtactctaagtagactactctagtgtattttaattttcttgccaattcagccactaggattgtgtcacttgtttttttgattttagtttttcgtatcaaaaagcaaaccactgtttatatttgagtgctggtttcaactgtatgctgcctcaaataaacttagattatattacaaattcttttttacatagatttcattggctatattcatatatcctcaaaggtttccattgtgtttgaagaggtatcctaattgtaataaatgcttttgattggggatgccagggaagctttgagactaatgtctcagattttttttaaaaaagtttatattctatagtgatcaaagatgtaagaataatttttcttgtcattcattggatagtccagtgagtgtctactgtgaattcttatattcacttgtaactaaacattccatttggcaaatttcgtttcataacttccctaatttcctctacactttgtagattgggtgagatacaattccatggaattttaccactgaaccagtggagggctaattttgtcatttgtaccagttaactaacttgggaggaaacagaacaacacactcctgaggtagtatccaatttttagtaaatttatttttattatttttcaaactgtcagtgatttggtttggtgaacaataggttaatacagacaatgttaggaattattaatctgatgcgctatctgaagcatcagtttcctttatttttaagatttttttcttctctgtagtttggataatatttaaaacatttccaagagttataaattagtatattttctatgctgattaataatgaaaccttttgtcttatacagatttttaaaaaatggacgtgtgcgtgcatgtgtatatatataaatatatatatatataaaatctcttctcacaagatgatgcagactaaaactgcattttacattttatatggctaagtttattgtttccttgtgttgtaatatgatggaaagtaatgggaataattctgcttcctgtccttagggaccagtaggaattttcccatgataagcattttgtccttaaaatactgacatcctgttaagagatcatgacactccaatgaccatgagaccctggctatgctagtcagccagggggctgaccattgacagtgatgctggtctccatgattaaatagtgtgggtcagcatgtcccagggtgacagaaagctgtgtgatcagtgtctgtcacatatctcagactcagggttcctttttaaaatgtgcctggatcgatgatgacttaaagatttatctaatttaaatctgaacaaaatgagtgaccaaaacacttctgtaccacttctgtgagctgaggtccagcacagagaccactccagtcaaacatgtgttgcctggagttgcaactagttggtcagttagaagcaaccacagggactggggtatttgaaaaccacttgagtgcatttattagaggaaacgaattttacatttgtgtataaaaattcaattgtagggtaaaatggaaactctgagagtttggttggcggcatctatataccatagaaacagagcctgggaagcagaacagtgagacccaagagaaatgttcctgcctatacttggtctgttctcacatttgcctgagctactgattgatcttttgagggtgatgagatggtcaaaatccaaggatatgatgagtttttacttctcattttctttttttttttattatactttaagttttggggtacatatgcagaacgtgcaggtttgttacattggtatacacgtgccatggtggtttgctgcacccatcaacccatcatctacattaggtatttctcctaatgctatccctcccctagcccctgaccccccaacaggccctggtgtgtgatgttccctccctgtgtccatgtgttctcattgttcacctcccacttatgagtgagaacatgtggtgtttggttttctgttcttgtgttagtttgctgaaaatgatggtttccagtttcgttcatgtccctgcaaaggacatgaactcatgcttttttatggctgcatagtattccatggtgtacatgtgccacattttctttatccagtctatcattgatggacatttgggttggttccaagtctttgctattgtgaatagtgccgtaataaacatatgtgtgcatgtgtctttatagtagcatgatttataatcctttagatatatacccagtaatgggattgctgaatcaaatggtatttccagttctagatcctagaggaattgccacactgtcttccacaacggttgaactaatttacactcccaccaacagtgtaaaagtgttcctatttctccacatcctctccagcatttgttgtttcctgactttttttaatgatcgccattctaactggcatgagatggtatctcattgtggttttgatacacatttctgtaatgaccagtgatgatgagccttttttcatgtttgttggctgcataaatgtcttcttttgttttacttctcattttcttaaagtgaaacaatttcatgtggtatcttccaagtatattttaatcagttgccaacccagctgctaagattgaactgtttcttttgttcttctcttgtttttttctattaatttagcaaacaattttatatatagtttgctatccttctccatggggcctgcatcttcagattcaactagccatggattgaaaatacttgacaaaaaattgtatggtttcatctgtactgaacatgtacagtctttttctctctttttctctttctttcttttttttttttttgagacagagtttcactctgtcacccaggctggagtgcagtggcacgatctcagctcactacaacctctgtcccccgggttcaagtgattctcctacctcagcctcctgaatagctaggattacaggcgcccaccactgtgccaggctaatttttgtgtttttagtagagatggggtttcaccatgttggccgggctggtctcgaactcctgaccttaagtgatctgcctgcatcagcctcccaaagtgctgggattacaagcatgagccaccatgcccagccaagtacagactttttctttggttattattccctaaaacagtacagtataacaactatttacgcagcatttacattgtattcagcatcatgagtaatctagaaatgatttcctgcatataggaggatgtacataggttctatgccaatagtgcacagtgctcgctgtgtttaaagaaatatcctaggtatagaataaataattttgaagtcagtgtgttgagaaaacactgacatggatagaaaatattctgtctagaatagaaaaaacaatagaatagaaaaagttctatctgtatcagtctgatcaaagatgtgagcataattattcttgtcatacatatagtctaatgaatgtctaaagtgaattcttataactgcttgtaacaaaatatttcatttggcaaatgttatttcacaactttcctaattgcccatgtactttgtagattggttttcacagaattccatggactttaactgctgaaccaatgatgcactgattttgtcacttgtaccagctaacgcatctgggaggcaacaaaacaatactctcctgaggtaacatcgaatttttagtaaattcatttttgtgtgttgtttttattatttttttaagtaattgagaatttcattaggtgtgcaaggagtcacttaatacaaatagtattaggcattcaatactctcatgagatatctgagccttcagtttcttttattttaacattttacatttttctcaactttaacatcagaaacatcctataagtgtaataaaattcttatactttacatatagttacatagtaaatcctcctgtcttatttaagtttgaaaaatgaacatgtatacttctcattcccatgtatataatctcttcccacagaatgaggtggaccaagaaactgggcttcatacggatgaatttatttttttccctgtgtggagacataaaggaaaagtatagtgaataattccgcctcccacccacaagtccccatgggaattctcacatgttaaaaagcattttgtcctgaaaataacaacaatttttcttagggaatcaggacactccaatgacagtgagactctggctatgccaggcagccatgggctggtcattgtgctgctggtctccatgattgaatagtgtgggtcattggtgacagatagctatgtgctcagtgtctgccacatatctcaggttcaaagtcccttttataaatgtgcctggatggatgacgacttaaaaatgaatctcgttggaatctgagcaaaacgagtgagcaaaccacttctgtgcagttctgtgaactgaggtcaagcacagggaccatgccaggcaaacacgtgcagagagttcagtttggtcagcaactggtaccaaaatggcctgtggtattggaaaacaaacccactcacatagcttacagcacatgaattgtacagaggtctgtatgtgtttgtatatatttatatatgtttgtgtacatatatctttggggattatatggcatttctttcagtgtttggctggcagtgtccatactctcatagtaaacagaattacacaagagtagagggaacagtaggaaatggttttgcctaccctagagtcttttatacatgtttttaggtgctataatcttgtgtgtgaggtcagtctctcaggttcattagatggacagtgtaaaaggtattatgaggttttacatattatttatctattaagtaaaagaaatatatggaaattgaagagtagcttttatctattaaagaaaagaatgtatggaaattgaagggtactttctatttgtggaaagtcttaacattttaatttccttattgatcttgtcacagaagttggaatttaagttttgcctgtcactcaaagagaagctttttagacatttgattaagggattctagtagatgctatagtaaacatttctaattgtaaaatgattaaatttgcaattcatagagttttatgtggatttcattgcctgatattcattatttttattagtgggtttcatagatgtttaaagggagatcctagttttattgtgtgatactaagggaggccttttggtcttagaaaactgactttcagtactacccatttccagggagtgagcataatttttattctcataccacatgggcaagtgaatatctatggtttatttcttataactcgtcattagtaattatgaaagtaagaaagttgacaaatgaaactcttttaattatgagggtttcatttgtcgacttcctacttcctcagtgtgctttgtgtattggaggtaatactggaattgcatggaattcctactgctgctccagtaacctgctgattttgtcacgtgtaccagattcgttgtctggcaatgagaacaatacacttcagaggtaatattgcaatttttagtaagtgcatttttcctgggttcgttctattattttattttagcaagtaagattataattggtttttcaagcagtctgttaatccaaatggtgtgaggccctaataatctggttagtcatctgaagtttctgtgttctttgtacagtatttttatacttcctctgttttcaaataacattaggataccctactagcaaaataatttagtatattttatatacttgtgcatagtaagcctgttgtatatgtacactatttgcatggttggcaaattacatttgcactttttatttttctataattttttcctattttcaaaggttaatgtggaccaaaaactagatttcatataaaagagtttattccttctacttgaggtgtgacatgaaggaaagtaatggaaataattctgccctcccattctcaagggccagggggaattcaaatattggtaagcattttgtcttgaaagcaccaacattcttcttagggggtcatgacactccaatgacaatgagaccctggctgtgcttgtcagtcatgagactggtcactggctgtgatgctggtctttgtaattgaatactgtgggttggcaagtccccaggtgacagaaagatcagtgttcagtgtctgccacatatctcaggcttaaggtcccttttataagtgtgcctggatcgatgatgacttaaaaaaatggaaaccttggaaatctgaacaaaatgagtgaccaagacacttctgtgagctgaggtccagcacagggaccataccaggcaaacccgtggagggcgttcagtttggtcaggaactggtaccaaaacgaacccacttgcatatgttagagcagatgaattgtacagaggcctatatatcttcgggaattacatgacaatgatttaagtgcatggctgacagccttcaaacacctagtaatcaggctttggggtaccagcgtcagaggagtgaacactgtagaaatggctgtgccagcactcgagtcattcacactattttcgtagacgccacaacattcttagtgagtatcagcatgtataggtatattatgtagtcaattagaaagaaattatcagtctttgcttgctatttattctttcactaaaagaaatatgtgaaaattgaagagtgggttgtattcatgggattatcttattacatgctggaatttgcttcctaactcagtctcaaggattagaacagcatttgtttttctttttcctgtcactcagggagcaattttctaagcattagatgatagattaaattagatgcttcattaaacattttaatgtgaaataatgaaatttctaattctagggattttagatggatattgttggctaataggaatattccttcattgagtctttgtatattttaagagagattctaattttagtaatactcggggcctttggccttcgagaccaaaatcttggaaacattgattttctgtacttaccctgttccaagcaacaagcagattttttagttatgtggatagtcaagtgactatggctaattaattacaaactgttgtcaggaatcattcagttgggaaggttttgtttcaaaactcctgtaatgtcccctgtgccttgcagaacggaagtgattttggaattgcatggaattctcactgccatcccaaagaaatgctgatcttgtcactcttacctgtttcattccctgggggcagaacaaaaggacgcactccaaaggtaacatccaagtttgaataaatttactttttatggcttattttgtaattttttctgtagtcaagtagataatcagttttgtgaatgatctgttaataacagtatgagacattaattatctggtgaatcatccaaggctttcattatcctttatttccaattttttttgcgttctccttttcagtaatatcaaaaacatcctagtagagttatgttagtatatttgatattaatatacataacaaacgctcccttcttgtgcatgtttgacaaatggacatatatacttaccatcttcccatatttgtactgttttcacagatcggcatgaaccaagaactgggtttcatataaaatattttattctgtcctcttgagatgtgacatgagaaaagtattgagaatacttctatcacctcatcttcaagaatccgtaggaattctcccatggtaagcattttgtcctgaaaatactggcattcctcttaggagatcgtgacactccaatgaccatgagaccctggccatgctagtcagccattggccagtcattgactgtgatgccagtctccataattgaatgaatagtgtgggtcagtgtaccccaagctgatggaaagctgtgtgctcagtgtctgtcacatatcccaggcttaaggtaccttttataaatgtacctggattgacgatgactttaaaaaaaaaaaatctcattgaaatctgaaaaaaatgagtgaccaaaccacttctgtgagctgaggtccagcacacatgataggcaaacgtggagggatgtggatggtcagtgcccacagggactggggtatttgaaagctaatctgcctgcgtatgttagaggaaatgaattggacagtcatctataaatatcgtattttttaataaaatggctattcctttggtgcttggctggtagcatccatccactggtagtaaatagaccctggaaaaccagcacatatgtagtgagaccccatgagacatgattgtgcctacctttgagccatccataagttatctgggacatgacagtcttttgagtgagagcagtttactaaggtcatttagatcatcagttccaaagatggtgtggatcttatcgattatttttttaggcagaggtaatatctggaaaattaagagtgatttctaaccatgagaatattttagtttgtttaaatttgcttgctaacccagtaccaagaattcagaccttttttctgtctgtataaagcaatattctagacatttgagtgattcaagtagatgttgtgagatgattacatttccagtccttggaatgttatgtggattttattggctaatcttcatatttcatcagtggattttcctatgcatgttaagggagatccttgttaattgatgtctaggtggactttacggttaacctgaacaggtcttggaaaaaggactttaaacattctcctgttctgtggaataagtatacttttttctggacatacaccttgtcagtgagtatgtatcataattcctcataacttcttatcaggaaacattcgatgtagaagatttctttctcaacttctctaattgcccctgtggtttgcaggttccatgtgatactagagttgcatagatttttaacctttacgccaatgaagatctgaggcaaacattgccccttttttagaagtttgcatttgtcactgataactgtaataattgatcttgttgaaaagcctgggaaatgaagatctgatatgtcacttttaccggcttcctcaactgaaaaagaatacaatgaaacacgctgaggtaacatctaatttttgatatcttttttcctgggttattactgttttaagtatttaggaatttaatgggtgctatatggagtcagttaattcagatactataagaccttaatctggtgagtcatctgaggcttctgtttgttcttttccagaatttttgtgctttctcagtcttgctgatgatctttctatgggcctgaagcgtggagagtgccagagaggctgatcctcagcagtgtggcagaggaaagttgggtgcgactaaggggtatgcggtgcccacatgccactgggtcctcagcagtaccacctggtgagcgtcactcttgagagctgagagtaggtgggaagcagctcatggtgagagggttcagaggccgcctttccctctctgcgcactgcccagttcttctagtcacatgtcccgggacagtaccatacctgtgtgtgtcctgcctgcattgctgtgaccacttttagtggaatcaggtgcagtgcagctctgcagcttctgcaaattgccacgctcccactctcaagcaggttgagtgctacgagtgatttttagaccatttgtttattcccttatcatggctttttgtgacttcttcctccccagtccgttgggtcacctttaaaggtaaagtaatcctgaggtggttgaatttacggaaatgctatgcattattgtgaatgggatgttcaccgggccaacatcttcttggaactttgagcaaactgatagtctggttgcacatttgatttgtctggcagtaaatgttggacagtatttggactgatggaagctagagacaaacacattgactattgttgaataacactggaaacatcttaggagagcagtacattagctaatttaataggtacataaactgaatcccactgtcttgtgcttgacggaccagcagacacatatgcttgtatcgttctcatgtttctacatgtttaccctattcccacaggtcaacaaagacaaggcacctagccccacatgaaactttattcctttcccttttgagatgtgacatgaaagaaaataacagaaatgatttttccatcccatcctcagggaccagtgggaatgaattttaccatcccaccctcaagggccaggtcaggtcgctaagcattttgtcactaaaatattgcccttttttagggattatgtaatactctataaggcactgtctgtgctgggcagcatggagcctgggtcattgctgtgttgggggcttggtctccatgacttaatagggtgtatcagtgtgtcccagagaagtgtactccagagtgctcattttctttcatgtttctgaagcaaacagtgcccccttttttagaagtttgcatgtgtcactgataactttaataattgatcttgttgaaaaacctgggaaaacagtgagttaaataataacttctctgaacatgaggtccagcccaattacctgccctaagcaaactatatggaaggagagttcagtttgttcagctatgtggtcccagcaaggactgtggtactggaaaactaaccagcttacatgcactagagaagtagaattggacagtgatctgtaggtacccagtttggagatgaaattgcaactctgagttcttgattggcaacataaatacgttgatagtaaacagaccctggggaatcagcacttgagttgtgaaaagcgggaaatagctatgcctacactagagccattcacacttttgctggagctgcaataatcttctaagtcatgcttgctctcgtgagggcaatgagatggtcacaatccaaggagagttggggttttcacttttcatttctctattaagtgaaaaaagtatatgaaaattgaaaaatagatattacttatgtaatcttcacagtataatttgcttgccaagcagtcactgggatttaatcagtttctttgtctttcgtttttctcataagctgagagagtaattttgtgtgcacagaagtactgtcttcagctacatgctgcattaaacattcctagatgtgaaatgattaaatttccaagtttttaaaatgtggatttttctggccacttttatatctcttcaatgggtttctaatggatttaaggagagagcctagtcatgatgaatggtgttgtgttgggtatgctgaggaaactttgagaccaatgtttcagaaaaaattatttctatactgtcatgtttcaagtaccgagtattgttcttgtcatacagatggtccagtgaacatctctggtgaattccttacaaccaacctcttgttactaaatattccattaggaatgttttgtttctcaactccctgatttcccctttatagattggaagtgatattggtggaagacaacattttgccgcttggaattctcacctccacaccaaagaagtactgtttttgtcatttgcaccagcttctttctccaggaaagatcaaaacgatgcactgcaaggttaacatccaatttttaatacatgtaattccctggattatttttgttgtgttattaaataacttagaattttttttacaaagtctgttgaaccaaacactgtaaggcattaataacctggtgagttatttgaggccttttttcctctcctagaatttttgcacaatttatattttgaataatatcagagacatcctagtagagtaatgaattagtacattttatatgcagatacatagtgaagcctcctttcttatgcatatttgacaaatggacatgtatatttctcatcttcccatatttttactccatttccacaggtcatgtagaccaaaatgtgaatgtcatatgaaagagtttaaacattgcccttgaaatatgacagaaagtatcagaaataattataccattccatgctcacaggccagtgggaattctcacagtaagcattttgtccagagaatattcttcttagggaactataacattccaatgataatggtagtcagccatgtggctggatcatcgttcctgtatcctggtctctatgacttagtgtggtgatggtgtcattgtgtccaagtgtgacagaattgttagtgtgtagtgtctgtctcctatctcaggctcacagtcccttttataaacatgcctggattgatgatggcttcagtatcttttggaaatctggactgagcaatagaattgcttctctcaaattgatttcaagtcatataaaaggccatgttacacatatattgttaatctgagggaggctgtgatcatttaagttgtattttataaacactaggaccaccagtaagaaaacaattcaaaaaatattaaaagaacaaccaaagaattaaaatagaataaccgaaaagatctgtttaacacaaaagaaggcagttaaagatgaacagaggaaccaataagacatatagaaaacagataggaaaatgacagacataaacccagccatatgacaattatattaaatttttaagagattaggaaattccgttgttttttaaacatgagcaactatacgctgtctacagaagagacactttagaacaaaagatacaaatagttggaaagtaaaaagatggaaaaagctatatccagcgaatccagaagagagcagaagtggctattctgacatcagaaaaaagagactttaagataaagtattgctagagaggaagaaggatagtatttaatgatagaagggttaatatggaatatgtaacaattacaatcatatcagcactaacaacagtgcccaaaactacatacactgaaatttaacatgattgaggggatcaataggcaattcaacaataaaagcttttgttcataccctcttcttaatcagtgataagtcaattagatagagcatcattgaggttacaacatacttcagcaatgttgtcaaccaatttgacctgagatagatagatagacagttagacagacagacagacagacagagaaaacttcacccaacaacagaaatacaaattattttcaagcatacctggaacattctccaggatagagtatatgttaggctataaaactgtactcaataaatttaagattgaaaccatgtagagtatgttgtgtgaccatagaggaattagaaatcaacacagaaataaatttggaggtcacaagatatttggaaattaacacactttacagagcccattggtcaaaaatatatatattaaactagaaaggccgggggtggttgcttacacctgtaattccagcactttgggaggcgtaggtgggcacatcacttgaggccaggagttcaagaccaacctgggcaacatggcaaaaccccatctctacaaaaaaatacaaaaaatgagttgagcatggtggtgcatgcctgtagtcccagctactcaggaggctgaggtaggggaatcacctgagcccagcaggtagaagctgcattgaaccaagattgcaccactgcataccagcctgggcgacaaagtgagaccctgtctaaaaaataaaaggaatccagaaaacatcttgcatagaatttgatacaactaaagacatgcttagagggatatttatagttttaaataactgtatcagaaaaaaagggaagataaataaatgacataagcttccaccttaagaaacaagaaaaagactaaactagaagatgaaatccaaagcaagcagaaagaagtaaacaatagggattggagcaaaaattgatgacataaaaaaccagacaaaatacagagaaaaatccatgaaaccaaaagttgggtttgtgcagagatttgtgaaatttacaatcctttagctagactgacacagatcattagaattaggaatgatggagacaacatcactactgaccctatagattggatcaggaatgtcgctgtttgctgcattgtgctttcttgaggggagagctatgaaggaaaacaaagttctcattgcacttacaactcaacaacacagcgttgacattttgattctcactggcttcagtgctcatctctgtgaggtttccagaagatcccgtagcaatatcactcattctaaatttatctttgggctactctgggaacgctgtctatgggttagccctgctctgcaaggagcagtaagaaaatatatatatattttttgaggctgagtctcgctctatcgcccagacgggagtgcagtggcacgatgttggctcactgcaacctccacctccagggttcaagcgattctcctgcctcagcctcccaagtagctgggattacaggcacgtgccaccacacaccgctaatttttgtgtttttgtagagacagggtttcaccatgtgggccaggctggtctcaaactcccaacctcaggtgatctgccctccttggcctcccaaagtgcagggattacaggcatgatccactgtgcctggcaagtatgtttgtagccagtggggaattattttaactaggcaataatttgatctattttgggaagcctcttgtaatcaaatcatatatcaacattaatcacatggtgagtcctccatggttttcattcctagagattctaggatgtttgacatttctctgcttagcttatagcagaaaggtattggatatcaagaatgtttgaacagtttctcctttttgggaatgaagatgaaattgggctagaatgagatgtgtgattgagagaatgtccctgaggcctgagcagtgtgtccttttgggtatgggcattggaagcatgtagtgaattcttataattttatgttgcctcggcatccatcttgagtataagtttaactttgttataccagaagcaaggcttactcacttttgcacagtttccagttctacacctccttctcgttcctcagtgtgattggtccagatagctgccttatccaactgcctcctttggaccacttcatcatgggacagcttgatgcaatctacttgacaagaccctggaaccccacacccctcatggaaccagtgtccacctcccagtcacagtgtgaccccagggaactcttgcctgcttgctttaaacccaccacttaaaagtctccacagaaaacctgtttgaatagtacccttgacccaataagggcattggcccctgggtgtctctctctctctctctctctctctctccctctctctccctctctctctctcgctccctgacctctgcgtgtggactccaggcatgccatatacccctcaggacctgtaagtaatactatctttatttttattttatatctctcctaatcattgaaaaggtgctctctatcttgaagatactatattaaataaaatgagaacttgtccctaacacagttagtgataggctgaaacacgctgattgcactctttacccatttagtgatttttctcaagttactctacaccatgtattatcaacataattgatattacagaatagaattataagacacttcttttgccacagaaagttctattggactcagattatctagagctactacatgtatgctattctatgataaaagatgtagatgtgataaaaacatttataaaatatctgtcttagaaaagttagctaaaattattttgggaaaagtatgtttgaaaatagaatcgtaagctaccacattgtgataaatatttctaaatgtgtctattaacttgtcaggagacaacagagtgaattaaaacagtagccttgtatcagtatgtttttattcagaagacaaatgcacgttttaactattatatgttcttggcttaactttttttgtaaagttaagacattacacttttacatgaatctgtaatttcaagatatcttaatggttgacagggacaggacaattgaagaaaacctgtaaatacatttggtaaaatttatgatggattgttttgcagatggcttcagaggttattagcacatctgtttgagatatgcacagttttacatttgtcccttaggtaatcaacagggctgagatcagtaaatcacatgtaagccactgttatgaggctattctgaatagagttacatcattttatcatatctagactttctagttatattggtgctgttgaaaatgattttgtattacatgctttcttccaaatcatagatcaagatattttatttatgtatgtcttttaaatgaagagtggttaggatagtcctgattattgcacataaatattgcctttcactagattattgttttgggccaaattttagactattattttaaaaaagagtaccttagtttaatccaacctttccagatacttagaaattattgaaatgtatattttgtgaagatggtcttatgaaagttgttgagctagaaacatgtccttcaccagtggaattcttagaagctttccttgggcttcactgggtgctaatagaccatgatcgtattgctctgtatataatggtacaaattttgttttataacactcagtcttaatagaatgggaatattttatcttactaacgtagtcattagctggccactctctgtgtccattggaccttatagggtaaagggagggcagtgcgtatttgaagcctgtgcacgtgacacacaaagggcttagcaacctccgtgttttcccagcacaggatacccattcttcctgaatgtttcattgttaaattagattgtgtgtgtgtgtgtgtgtgtgtgtgtgtattttatattaacatacagatgtatgtattttagttgcattttttttcttaaaatgttattttttctctttttcttttatgtcaggtgatgatagagcccctagggaagcaaaactgtccatgcccttgccttaactttcagatacgataaaaacaacatttataaaatacctgtcttagaaatattagctaaaattatgttggggaaagtatgtttgaaaatagaattgtaagctaccacattgtgataaatattactaaatttgtttattgacttgtcaggaagcaaaagaatgaattaaagaaaactccagagaatgagctgacaacctactccctggtcagtggctctccatgcctacctgtggtctcttggacacccttgcaggtatgtgggcagggaactgcatgtttataggaaacaggcctaggatggaaggagttaatagatcttgctcttcttgagtttgatgacatttgtttccagttaaatagcatgaaaacccatctgagagccagctgagggtggatacagttctggggagttaaagacgagtggtcacaacaggtcttcctcggcaatccgagcccaaaactgaatctgcctccataagaccattatgtgtcagctctttatttatatgattgattcatccagtggacttttaatttcttatgtccagatattttttcagttctttttttcgtgatacaagcaccttgtggattgcctgtcatagaacaggttctcaataaacttttattgaaaaaagatgtataagtagattgtcttgagtaattttgtgaataacctgaccaactaagcagtagaagacaaatgattttaaaacagaaagagacataactttcagtgggattcaggtgatctagtcgggtctggaaatgcgcaagagagaaggtccctgatgcagtgtgctgacattgaaatgtgtagttgtggactagatggttatggtttcagaactgtgtaagtaaggggtagattccaaattaaatcaatattaaagagtagcagagaaggaatttccagattccagctgcattgcttgtttcattggaagtggtgtttctcttttttcttttttttctttcttttttttttttttttttaaacctcagaagatgacttcctgggaactcttctgggagtgaatgttatcagcaaattcccaaaacaacaccccttagacaaaaagcctcctcacctatgcattgcctagaccacccactaaaggtaagatgttagttaaaatagtccttgctttctgggagaagccatgtcttagtagaaattgagctgttaattttccgaatattgatgatgtttgattacattctaattgattctaagatttcataatatgttaagagatgcagcttttcttatataccttcgtggcttttctacatctcagtacatttactgttaatatgaaggatttccataacttctctcatctagtaaactgaactccttcatggcttgatccattgtgatgctagaaaattgttgtacacagaagacacagtagcctctccataactgttagactggaagtttgacaaactggtctgaaataactgatcaaatcaatgaatgacctagagctttaagaaaccagatgggaagagacagacatgaaacccaaggttgttgatggctattacttttgagcccagcaaaaggagaaaaagcagcaccaatatctggcatcctggacatgaggaagttttaatgtcattgttttggcctcatcatggacccaggtgctagaaatgagattttctctgtgtactctgggtatatttgttctagcacaagtagggggaagattaaagaggaatttcatacccccatgactccttaggaaatgtgtttctcacctttgccacttttccccactgtgtccttgcaggtgatggccacaaagaggtggatttgttgagttggtgccattccttctactgccagcttcaccaaaacaatgacacagtcttccttccgcatggagactcttctctttcctgtgttgcagtggatgcctcctgcagataagaaatgcttaactgagaaatgctcatgttgggatatcatcgatgagactttaatttgggcatggtgactgtttcccttgctgccacttgactcaatcccaggagcctcagtagaggatataatattacacaagatgctcaaaatggtggaattgctcagtgctcccataaatatacatttataattttcatttgccacatggtaaactgaaaaatacagactatattaaaaagaaactgcatgattttttttcaaaaattcaaagcatatttaaataatatataaattaaatgccctcctctcttccaattctgtccctatagttttcctctattaagtgaactacatgcattcttttagtggatagatgcacacaaacacacaagccattatggggaaggatccacgtgtgtggccatattgtaacacatttttctgcaaatcacctctttcatttaacagcccttattcaatggcctttttctttttcagtagtacatacacatctgtgtcatttgttgaatgacgacatgaatgttttgtagataaaatataattaaatgttttaagcatttctcactcatagatatttatgttagcaccaaatttctgtgcaatgaacctccctatatatcagtaattttgcatttgtctataatatcataataaattacttatcagttgaattactgggattaagtatgtgcacactttatatttatattttgaaaattattgcaagattgccttcaaaaatgtggttaacaactttatcttcaaatggcaatgaatgagattgccagctttcctacagcctcacagacaatggattttataaatatttaacatttttgccaatgtgatcacccaaactattgtcttaaattgtatctcttttgtttttgagtttggtcattttttcatgtttattagccatctgtattttttaatttcttctttatgtccaattttgtgggtgggaggaggatttagtctcttcctgatttcgaagagctcatttactatttcgggaaataagatttggattgtcaaccattatagctattttttacacacttttcaactttgtttttgttataagaatgtgtatgattgttacatgtccaagtataaccatgttcgcttttatggcttctgagtttcatgtcatttttggaaagatatatatattgagtccataaaacccttcacctatgttaaattctaattcttttgtgtttttttaattcaaattcttaaatcatgagaaatttttttgttttgaaatcttaaagttgccaagttacttgccattacttgcgattatttgccaataattgcccatttatctgtaccgccatcttgcgcatatgctgtactctcatctgtgactggctccatttttgttctgtggatttgtgtgtctcttcttctgcctcctgtctcgtgtctgctcgttggaagaaattacagtttagactgcaatttcatcaactttaataaatcaattgaggggagaattggtttttaaaaatattaagtaagtcttcgtatccaaggacaaggtatgtcttttcttattcaataattttaattactgttaatattttcactgtggtgatgggagtttttcttttaatttattttcttgttcattttttgtatctaaagtttttgttttgttttgttttgggggtaagttgtcaccttactgtttcttgttgcttttcagattttttcaaagtatagactaaatccttcacaaatatttaaagtttttattttcccccttcatattgatcctgattttagttatgttgacaaagtccacagactgttactatcagaacacttgaacagttatggaaatattacctacccttgatttaatcagagtttaatggtatgcttctttggtttgactggcacattgtcgctggtcatttcctcccaaagaccaccagaaagagctatgatcaagcaaagctgagtttgttaaacttacctgcagcaagggaaaacaccaccttgatagggtttaataatgtttcaaaatcaagaaatgaggctttggggtctgggcagggaactaattagaaatgggcaaaatttgtcatgcaataccttgtgggaaagtgagatgaggttcttaatgtgagtattgatggtgaaatcattttctaggtgagctgtttgcctatataaagatgttatcaatgacagaagaactatttgcctagataaacaaactgaatttatttattggtttacagttttatcttgctgggcaggactctgctgggggtggtatcaggtcttattcccaataggtaagttatttggatatgggtggtcttaatcatcaatgtgtaaaatgctgattttaagtgcgaaatactttgtctaccatgttaggaaagtctgccaccttttatcttttttaaggaattttaatcaaaaccaggtggtagatataatcaaattgttttgcagaatcaattttcctgttctctttaaagacttttatcactgtgaattaatttactattattgcaacttcctttaattccttgaatgaacagaccctactggttttaaaaatgttttattcttttaatttactacttaattgtgggtattttaatttgatttggaatttttacaagtatacaactaagtgaaattgatctgtgatttttcttttttgtgctatttttgtcatgttttgatatcagatattctggttgtgttaaaataattttgaggattttcttcttatactgtgttctagagtgggtaaaaaagccctagtctcactatcagtgtttaagtgaacacatcagtgacatcatctggactctcctttgtttttgctggtttggagttaggacatctagaagtttttttctttttttcctttttttgtatggttattgcttgttctttgttttgtgtcaaatttaacctgttttctcttagcaaatcacagctcatgcagattttcaaacacattagccttgttatacaaagtgttctttcatcattctattaaatttccattttcattccagttatagttatttctgctgtgcctttgttaatgaataagtttaaacagtggatgtttagcatcactagccttccccttccatctcccttaatcaggaccttggtataatttatcaggtattttttaaggttctaatttacttatatatattgtttctgtattcttttgtttcttttcttaataaattcttaaacctgtgtaacacattcatattcacttgttcttggcaatgaaagatttaccctgctgtgcattttataaaacttgtcattatgaacacattgtaaacatacagtgtatgaagagaagaaaacagtgaactagcacatacaaggaactggaactggttccatcattatcagtattttgccatatttactttgtgtttattttaagtattttcaaataagctagagaaatcttaacgcttcttattctcccataaacatttttacaattttatttttgaatgtgtatgtatacacattcgtatgcttttatattgttctataactttcttttatatcatgtaatatataaatattttaatatttctatctgattattacatatccatagatgtgaagcttccctatttttaataacttatatttttacataagtaaaatttacatagttaaatgcattgatatatagtaattgtataattcaataagtttcttaaaagtaattactatcccattcaggagatagaatatttttattacttgagaacctaccctattgcctctttccaaccaagcaccttctcaaaaaaacaatgttgtgatttttatgatcatagataagttttgcctgtttggaaattaatataaatggaatcacacagtgtgtgtctggcttcttgcactcatcataatcatgttgagatttatctgtgctattccctatatcagcagtttaaaaaagtttctatagttgtaatatttcactaaatggttatattgcagtttatctattctcttgttgacggacacctgagtagtttctagtttttagctgttttgaatgttagcagatctcttatgtaaatacctaaaaattgaattgtttgatcataagacagattttgcttaacttataggaaactgctagagagtcttctaaagagatggacacttttcgcactcccaaccagtgatatgagatttttagttgctgtccatttttgccaacattggaaattgtcagtcttatctattaagtgggtgtgaggtgatattttgttgtgacttcaatttgaaatttgaccacttaagaaggcaaccagtttttcatgaagttatccaattgtaaatcttctttagtaaaatttgtatatttttcccaacttttaaattacaattttgaagtaattttggacttacgggaaatttgcaaaaatagtagagttcctgtgtattctgtacccagctttctggatgttagcattttatataatcattattataacattattacatacaatgataattgaaatcaggaaattaatataatactgtcaaccaatctgcagactatattcaggtttttcaagttatgctactaatgtcctttttatctagtccaggatccaattcaagatctcttattttatctggcatgtttcctttgccctctctcctgactacaaatctgggagagctccctcagtctttctttgtatttcatttaattgacacatttgagaaatactagaccataatttggtacactagtcctcaatttggatttgtccgatatttttattattagattaaggttatgcacttttgacaaaagataacacagtagtaacagtgtgcccttttcagtggatcatctggagtacatgaagttaatgtcttatttctgctgatactaaatatgacgcctttattaaggtagtgtctgccaggtttatccactgcaaagttactgttttcctttctttgtaattaatattttatgagaaaataatttgagactatgcaaatattttatttcatctaatttcagtattaattgaagattcttgcctgcagcaattatgattatggtgtttacctagtaatggtttctatttccatgatactttctctacttactagaatttgactgtaaggaagatctgtccttcttccccatttatttgtactcagttgttattttacatcagtatggatttgtggatatcttattttatggattgttatatattgcaatcattgtttgtgtttgattttcaattttttttctggatttgatcattgggagctccttaaagttggcccctgtgttcttttaatacaacctcataattttttgaccacttcttattttcgggtatcacaagatattctaggtttatcttgtattttccttccccacgcctgtaatcaaccatttcctcaaggggttctagttcttcatattggaaaatagtatttagaaaccaagatcttggtattaagtgtattaattgctaatggggttttattgcttctaggcctagagctgggagctgtgtgtccgtttacacacatacacatacacacacacccctatattgtctctattcatttatctatcttaaatatatatactaatagtatgtagaatactatagatagtatatatctatctttattaaaaatcacaagttcatactgttgtggatcataatccatcatcatatggttcattttattcttccctcttggcttatttgtgatttgcttcttcaacagtgagaaacctacctttcattatctacaatatgttttgttatttcttcagtgcagtatacacttaaataatttcagaattgctaaattatacccctttaaaaatgaaatcactaactacagcacagtatttaaatatagttcttttgtctttatccttaacagcgttcagtcaacatactattatttctaaacgtatttaggttagttatcttttttttcctatcccctgccatatggttacattaatcatataatcaagcaggtttttttattgtttatattccattttgagttccctcaccttttggattattttaactatattttgtatatgtgaaatattactatgtttctaaaaattaggactgtgagaaataccactctcccatcatccctgctacactgattctattcctcccttctttccaccctaatctcacccaacccttagagttaactagtctaatagtttctggtttatttttttctcttgttattcttgttcacaagtgggcagatacatgtatattttatcatatatcacatgtatattttatatccccttccttcttacatgattagtggcatactatagatttttttttgttgcagttttctttttccgcttaatatgtcctggaaatcacttcatgtgtattcaaagagatattcctcattctgtcatgcttagtgcttaactccatggatgcaccacaatttattcaacccctctgctctatgagaattgtttgcaatatgtgtaaagtatcacactacaaatagttttacattggattgtttatttgctcttcgtttggaagtgttctttgtattactgggacatacatttcttgttcaatatatgtgttgcaaaggtttctttcattaagtatcttagcctgcctgccttcctttccatttcctttctttttcttttctttcttctccttttaatgctgttatgctctaaattttaaaatggcccgaatttgccagtggctcatcccttattgctatttattcttcctctccttttctcccccatctcttttcctttaatttacgtgaaattaacataacgtagccatttagtgcattcaaaatgttttgcaactgccatccttaactagttccaaaacattttcagcaccccaaagacaacccatacccattaagcagtcagtcccaactctctttccccatcttttcatttttgttttttggagtttttttgagacaaagtctcactttgcacccaggctggagtgcaatggcacaatcatagctcactgcagcctcaaattcctgggcttatgcaatacttccaccttagcctcccgagcagctaggactacaggcatatgtcaccacaccaggctaatttataaaaaaaattttttagacacagagtcttgcagtgttgcccaggcttcttgtgtctttcgataaacagacattgaaaatttttaagtccagtatatcagtttgagtctcttatttttagtgcttattacttactattaaatctttgcttactccaggtttgcaaataatagttttctaagttttcttctagaagctttgggacataagtataacatctatctcaaatcattttcaaatgtagttgaagttacttgttttcatcaatctccagttgttgcagaaccatttgatcaaaagatttttctttttctactgaattatctaatgccattgttgaaaataagttggccatttacgtatggatcttttttgaactctctgtttttccttctttatgccattctttttcactgaagtttaatagtaaatcttgagattaagtagtgtgagtccaaaattttgttatttcaaggctttatagaggaaggagatggctacactgggtcctttgtatgttcacttaaattttaaaattatcttgtcaatttcctaaaaagcccaaccgagaaattgattttgattacatcaaaactatagataaatttaggggggattgacatcttaacaatgttgagtctgtagttctccatttattaggtcgtctataatttctcatagatgtcttttatggtgtttagtatagaagcataccttgtagttttcaatatagaaacattattaaaatttaacatttaataaactagattaaattgttaaatttatttgttttgttgttttgatgctattgtaaatgaatatgtttaaatttcgttttccagatttgttactattatatgaaaacagtaatattttcacattgcaactgcttttcagttgggttgtcttcttttcagtcttaggagaaaatatgtaatttcttaccattaagaaagatactagctgttatttttttgtagatgcccattaccaaattgagcaagttttattctagtgccagtttgctgttaatttttataataataatgtgataaatttgctgaatgtttttctacatttattaatataatcatgttttcccccttattctcttattatgggagactgcattggtcagcttttgaatgttagcccaacattgcattcttgatgtaatccaattggtcactgttatccttcttgtatatatattactgtattcaatttttctgctagttatttaagagttattcacctatgtccgtgatggccattatcctgtggtttcctttttaaaaattatttttgtcagatgttggcattaggcttcataaaatgtatttagtatagtgctctatttgctagtacacttgacccttgaacaacagacatggagattaggggttcagactcccccatagttgacaatctgtggacaattgtttgctctccagaaacttaactacgaatagcctactgttgactgaaagccttacagataacataactagtcaattaacacatattttatgttatatgtattacatactattttattaacaataaagtgaatgagagataaaatgttattacgagacataaggaagagaaaatatatttactattcgttacgtgaaagtagatgatcataaaggtcttcattctcatttttatgttgaataggctgaggaggaggaagaagaggaggggttgttcttactgtatcggggtggcagaagcagtacacttggtgtaactgtatggaaatatagtttctagcttttttgatttttcatttctctaaaaatgtttctatatggtacagtccttcttccactgtttacttatttgtagtacccacatcatagaaggagccatattgtaaagaagtcaaatgcagacttaaataattagaaaccttctgccagcgtgtttttctggcactccttctgtgtcgtcttccttatcgtctggtactggttcagaagcacttgtctccatcacgtcatcttctgttaattcctctagtgtgttatctattagctcttgaatttctccaaggtgtatatcttgaaagccttcactcaccacccttttttccgtgttcacgatctctttcgtgatttccttggttggctgtattgtaaatcctgtcaagtcatgcacaacatctggacacagtttcctccagcaggggagtgtgttgtgttgggcttgatgctttcacagctttttgtgtaacgatggcatcttcagtgctgtgatccttccagactttcatgatgttctatcagggttctcttgcatagtgttagataatcctttccataaagtactgtgtgtaatgagccttaatggtccttatgactccctgatctagaggatgatttagagatgttatgtctgggggcaaatagaccactttgacaccttcagtattgaactcatggggtcagggacattgtccaatcaaaaaaaaaaactttaaaaggcactcacttactgcaaggtacttcttgacatcagggtcaaaacatcaatgaaaccaatacagaaaaaaagacttcttattgtccaggcctttttgttttacaatcaaaagaccggcagctggtgttttaacttttcccttcgaggctcaggagttagctgctttatagataaggtcagtcctgatcataaacccaattacatttgcacaaaacagtagaattagcccatcccttcctgccttaaatcctggtgctcacttctcttccttactaataaatgtcctttctggcattttttttttttcagagtagggcactttcgtcagtttaaaaacctgttcaggcagatatcctttctcctcaatgattttcttaatggcatctgggaactgcttctcctgcttgactgtttttaagccagacttctttctaaaattatcaaaccatcctttgctggcattaaattctccagatttagaaccttcaccttccttttgcttaggatcatcttgcaccctagaggtatgccttacagcaatcctgtacccgcagaaaagatgcattttcaatagatagatactttgcaaaagtgcaaggttttcacagtgttggtacagctgcaacaatggcttcatgaatttccttttttttttttttttttttaacaattgtcctcacactggatttacttatcttgaaatggcaagtagcccctgctggagacctcaatctgtggtaccttttaagcaattaaacgttttcttgtaatgtcatgactttcctctgcttcttaggagtacttccagtatcaccagtggcacttcatatgggtcccatggtgttaaggtttatggtattacacaagacactatgaaaagtaatatgagaactgtgaaagcttttgttttgctgccacatgcaatttactggagggagaaactgtttcctggcatgatttcgggtcacctggcactttaagcagatgcaattgagctccccactgtagcaaaaggaggtggctacaaaattattacaataatgctgggtgtactacagctaattttatgcagttaggatttaataccacatatttacatttctctcaactgcaaatggcaccatgtaggatctgtgagtatgtgtgagtaggttttgataaattttaactttttataatttgtgtatattttatggtaataaatgataaaaataggctagtatctacatctattttatgcattcatgacatacctttttcttaatttttttggtatttctggactacgcagttgagttttttcaaattgtcacaaatttccaaaaatgtatccaatgtatttattgaaaaaagtctgcatataaatagatcatatgcagttcaaacttgtgctgttcaaaggtcaaatttctttgtggaatgtttgatagaattcattagtgaaatgatctgggcctggagtttccttcgtgatattttaatgaacaatttcagtttatttaataatacaggattgagagtttctgtttcatttaatggcagctttagtactgtttttcaaagagtatagtccattttatcagatttgtcaaattcagtagtataaagttgctcatgatagttccttattacccttatactgtctgtaagatctcacctttccaattctgatataggtaatattattttttctcaggttggtctttttttttttttttttttttaactatcttgtcatttaaaagaatcaatctttgatttgctaattttctctttatctgttttttatattattgatttctttccttcatcttaccttggttttaatatgctcttttttttggtagcttcttaatcttgagactattaagtcttctattatgtaccttacttattttctaatataaccattgaaggctataagcactacattgatagattccacaaactttgatatattgttttaattaccatttaattcaattattttcttcctttgtgttttaatttgatctgttatttttaagtggagtatttaatttccaaatatttggggcttttctgtgtagtttgttacaacttctgttttagttttgttttggttctaaaaagttactctgatatttcagctttccaaatttattgagacttatggtctagcatatgatctgtcttgacaaaagtttcacatgcacaggaatatatatttaaactcaaggtgtgcagattttgttcagatagatagtgtctagattttctagattgtcagtgaatttttacaattgttttataagttacaaagagaatagtgtaaaaaatttctgctgtgattatgattttctttatctttagttctctcagttcttcgtgtatttggaaatatcttattgtttatacttttatgaacatcatgactgtaataaattttatcttttcctaatttggcctgtcttaccttatgtaatatttctggtcttgatgtctgcttcgtctgatatctgaataatattaccagttttcttgggtttgcagtatgtctggtgtatctttttctgttctttaaatctgtcttcatagtgcttccattatagagagcatagagatggatcttttttgtccaatttaaccatcagtgacttttaagtctttggggtcttaagtccctttgcattaaacatactaacgtgactagacttatgcctactatttagctattgtttttccatttgtcccctctagtttgttcctctctgcctgctttgcttcgttcttttgggttaattgaatatttttagtatcctacattaacttctctgtttacatttcggctccacctctgggtattttgtatgggttataaaatgtacccttaatttatgacaatctgcttagagttagtattgtacacttctcatgaagtaaaattttatatatatatatatatatatatatatatatatatatatatatatatatatatatgagggagtctcaatctgtcacccagactggagtgcgggggcatgatctcagctcactgcaacattaggtggaactgtattaactctaaaaggactgtgataatttaaagatgtatattataaccatagaataatcactaaaaagtacagagaaatatagctaaaaaagcaacagcagaattaaaatgtaatagtaaaaatacttgattaaaagaatacaggaaagaatgaagaaaagaacaaagtaaactgtatagaaaacagatggcaaaatggtagacctaaacacagtcatattataaattactttaacggtacacttgtttttcattgctttaattgatcaaatgataggtaaagtattttaaagtctctttgtagttttctttaaatcttaacattttgtgcaatgtttgctttgtgaagattgatgctatgatatttaccaatcatttagaagagatattgctgggtgttttggtaagtttaggttacttacatatcttatatgatgaaatcaacattttttatttgatcaacttaatagaggcatcctgtttgaaagaagaaaataacagatctacaaaattctgattcatgtaataagtaaccattatgataataaatgtttttatttattgagtgcatactgaaaagtggtaggaagattttgtgctgaaatatttgtaaacctagtaattaaaaaatgttttggctgggcttgttggctcacgcctgtaatcccagctctttgggaggccgaggggggtggatcacttgaggtcaggagttcgagttcgagaccagcctggccaatatggtgaaaccctgtctctactaaaaatataaaaattagccaggcatggtggtgcacgcctgtagtcccagctactcgggaggctgagatgggagagtcgcttgaacccaggaagcagaggttgccgtgagtcaagattacaccattgcactccagcctgggtgtcgcagtgagactctgcctcaaaaaaaaaaaaaaaaaaaaagctgctaattaccccatgctaaatgtgttgtaatggtattaatttgatatataacatatatgtaacattttatatatgtgctcatatgatgatactgataatacctccctcaaattgctcttttgagtattaagaaaagtttatatagaaaaaccagtttggaaaggtttggaacataaggctacagtgattagatgttgagaacagcagcaataatagttgtcattataatatctgattaaggcaatatttgcacccaggtataccttgcttcagaactgtgtgattaaccattataccttgaggctattcataccctaccttcactttgttggcataatctgaagttttaaaccataatcacatattgcatttgcacaattaaattttaaaatatatacaaattacagtcaaattattgcattcatttcatgactatattctgtttccatccataagtaccgtatggtcaacaataacatgtcaaagagaattttgttgtcacctcgtttcattgtaccatgttcacactgttctttatctcttttttccattggcagtattgtgttctcaagaagaattattccagaagcacccctgaaataatatatttccttaattttggtattattagcccttctttgcttttctctataaattgtcctgatcagtcacctctctcaattatatacaacacaaagtagcttaaaggagaaaaaaaaggagataaataaccatgttgggtctggcgtcaggcttaatggagtccagtagtccagaatttaaagacacatatgaccgtttgctcccttatctcttagttctccatttcttggtttggcttaaatcttcagtcactttttctttatgtgaatttgcaaagggatcatttgaagccctagatgcaattattacctgccttgcaatcttggtaggatgtgtcctccttccctcctccttgtccatgtaaaagttggtgggtgaagagatggacaaggcttgagtcactaagacattcactgacctgggaataactcaggataggtctggtcatatccccaatggaggcaatgtaccctaatgaaaaggtcagggtcactggtctcattgtccaaggtgttatctgagctcatggtctcacaaccaagaaaattaaggagtatggacacagggtgaggttggttggagcaaaagtttagtaagcgaaagaagaaagctctctgcagcagagaggggagtccaagtggattgccgtttttacagtcattcaaaagcttttttaagaaactcctctcatctctgtagcactttgagtaacttctcttatcagcaaagctgtctgtacaactccccttatcttatgcagctgtgggtatgtctctaggcaagcacaaagcgccgcttatttttgtttgtgtaactgagggtttgttttaggtaagccccctcctttctgtgcaggcttccagggagcccaccatgtacatatctgaaaagggaaggaaactttttgctgggagcttgttaatcatacaaagaataaagggcttccatgccagactttgcctgcctgcttatctatggcttatctgtgcagctatagcctgagtttcccctggctgctctgtttttgcctgtagctgtgattttttcaggcagacagcttctctgaggactagtctcttagctgtttactcaagtaatttttcctgtccttttccctcactatgattaccagctcccctaggacttcatggtctggaatgaaatattccgtgggagtcagggaaagggagtttgttgcaaacatgtccaggccagacactttatataaagtgtcaaagtaaagtacacttacataaagtgtaagtgctgccaccaccactagggtgccaggtactctaacacaagtctttattcccatagatgtgagttaacatttataccaccagctcacactatcaaacaatcccacgtaccccaaataaacactggtgcctggtgggcagcaacaagccctccttcaaggaaggagttcatttgttggtttatccagctgctcccgctttgcttatggaagcgctccgttttctaggggtcttagaagctgtagcagtggtagaaagccccttttttgtggactattatgacttaggcttttatcagagcctcagagaattgctgttgttttgttggttaggctttaggtttccaatctgcatacacaattcctttgaagcaccaggcttccaggcaatttggttgagggaacttattgggatatgaaatattatcaggcaccatttctaatcaatgtacctaagttatgacttcaggtttagagaaaaaaaaaatttttttcccttggcttcaggcttccttctggaggtgataacctcctaaatggactgtctttaagggcctgtggcatgtgccctcctttcaggaaactagtgtatgcctggaggcattggtaatggcttctctcatcttactgtggcttgggaagaatatggctattgcagattttctagtttcattaccacctgaccttcaggctccttacatgttataggcagaaaaggtgcctccacaaagttgtgggctattctctgctttcagaaggacagctggaaatggtacttaattctttgtagcagcaccatcatgaatagctgcccacacccatatacatcattatcttttttggtgaagactctaagacttcaggccatgatatccacaaggctatgttcatgcactacttcggtataatctcaaaataattgccagctccccagtggaacgcctgccttggtccatgtggaatgtgggcatatggtaggatttccttggaggaactagaagaggaacataaagaatgttaggcatataaattattgtttctttttcttcttgtttctttccactgagttatgtgtgagcccccacacccaccctaccttcctgtcctctaccttactgatgctattttcaggctgttgtagaattgggtgtgtaaaattaaattagcctttctcctcttaatatctgtaaaatgaacaaatttgacaaagaaactacctatctgatatataagaaggttattagcctgtaccacaagtgaaaaagtttcatcctgatatatcaaaatagtaccacttgaaggaaaacgttggggccatctgtttctctcattgtagttagagtacagatttttaaaatatgagcctcaggcataaaaatgcagtattagcaactcaacttgaagaagcagttactagtgtcctgggtgggccccagggaaaatagtaccaactgcctgttatatttaactgcaattaaaaatggcagtgctgggtatcttctgtctctgggtcatctcctaaagatcctgcagagggagccatagctagtgtagaggccagccataactagccatggcaaagaccacagggaacgctcttcaacatgctctgcactgatcctctaccctggtgtggagaaatgtcagattcatcactaacaaggttaaaggtgtaaattgagggaaaaaaatgagaaaagttatctttcacataagacttcagaaagaaattgcgtcgtcaggtttggaactggtttgtaatttcatccagttattttcattttaattactgtcactgttttcttcatccttgataaactatgagctctttgagattgtctttttcatatcctgatgtcagagcttcctgtattttctgatcatggtatgtgctaagtaaatgcaatttttagcattttgaatggtttatcaaatgattgaaggagtgggtaataatatagattacatatacagtcagccacatatgtgtatgtatgtgtatttgtgtgtgtgtgtgtatatgtatatactgttgaccctccgtatcaatgggtttcacatttgtggattcatccaatcatggatcaaaaatattctttaaaaatatggttgcatctgtactgaacaggcacaaactttttttcttatcattattccctaaacaatgcagtatgacaactatttatcatagcattgacactgcattagatatgataagtaatctagagattaaagtatataggaggatgcatgtggatcatatgcaaataatacactacatcttatataagggacttgaacatccatggagtttggtatgtggtgggtgatacctcctctttgaggaggtgagtatcagagacgcaggtaaatatgatccagagggcaaagaggcattgccagcctcacactggctgtcaacaccatgctgagttccacgaaagcagcgaggagagggtggtgttcttgtttctggtacaatacctggcatagagaagatgtcacagcaatgttcgtctattgaataagtcaccaaaattgtgaatgactgaataaatgggcaaagggatttgttccctacttgctgtgggaagtttcttgtagttatgacctccatgaaagagagactcgtatctggagaaagttcatagctgaaaccatgagatttaacttttgaagttataatggatctatttttttaacatcataaatgaagattatgcaatactgtatgtgcttcaattgacacaaccccttcccattcagggctgatttatgttctgtactgaatgacaggcacagaagtaaatgtgataatcctgtcccgtcgttaccctttattgtggtcttgctgtgtcccagccacacacttcatactgtatctgtgtcatcattctcatatacatctatataggtacacttccatagacttaggcccatttaatggaggagcaactccaacatttagagatcatgaaaggtacctcatgacatatattgacctagtggcagagctgcttagttctacagcctctgagtggaatcctcacgacagtaaaaacacaagcttggtttctcacacactctacctgctttttctcatcccctttagtctctattccttgctgagatgtgttaggcattaaatggttacagtctacttctgtgtgtagtctccaaacactcagaaacctcaaaatttaaaaaaatacagaacaatatgttattaaataatcagggacaagttaaaatggtaaagagaataggccactttgtgaaatcatatgcagggaagaaaaaaatactggagtgaaaacaatataaaaataatactagatgctgtttcgtagcaccaagtgtgttctagcttctgtggttgttgctttatatcattttatataatctttacacaaaacctacaagcagatattatttcccctatttcaaaaatgagaaaaccaaggcaaatagttggtaagtagtacatatatattatcctaactctgaacttctggattcaaagaccatgttctaggataccattttgtgtaccagcatggaatatgtttttagttcatctatttactctaaaaatgtggagcatgtagtgtgagacagaactgttctaggctgtgaggaagtagctgtgaggatggtagtatgggtccctgtaataatgaaaatggaatatattggtatgtacaagtacatgctcattaaaggaaattgatgttggcatagattgcctgggttcaaattcccatttaccatgttttcctagttgtctctgtggtgagaggaggtggaatgtactagccattaccaaaattaagagagattgttggaaaaagtctcatttagcacaataacacattaaatgtattcaataaatgttacttatgactctttgagaaaacatacgtttaaaaaacatggcttatgttacacatactatatgctggctcccaaaaataaacatatttcccaagaagtgtctgttgataaagccaaatatattcttactacactaaggggaagcccatcttagcagtgtctcagcagcatattaggggcgtgggggacaaaacaggatatctgggatcttgaagtttcattttagatgggtctttcagtgtgggagcttgattaggattgggtgagggtcatgacacagcattttaagattgaacgttaggattttgagatgagggattctacagtgtggaggcataagctgtggtctgatgctttctgttgatgagttgatggtctttgggaagttcccaggatgaacaaaaatatttgcaacttttatcttcctgggcaagagtctcagaacatctacacttatatcaatgaaggtaaaatgataataatgtccccagcgaagacaggaagccatgtgggtagataatgtaagttgtgtcatttcatggttccatggataagcagctgtacttaagctgcttatcctggtggattctggagatccacacttgaaggtatcaacacagaaatatactaagaggattgtggtcagagtttgttgtcagctactgagtgaggagccaggaacatacagcttttaccaagaaaatctataccatccacactgtgatgagcccacaagaccagatatgggactttagccaaattacctaattttattatgtctttgattgctttctggtccttatctgggatatcagagatcccagagagatggcagggatgcaaattaaacattcttcccccaaaaacaacacatttttcccttataaaattactatattctgaaaaatttcatgaacctccaagtcaagatggggcattgtctaacttgcctgctgtttgctatacaatagcatggagtcagctccaggcttcccaaccctttcgaaaagcatgaattgaagaggcttaaggagagaagaaagcaacccagaattccctgtgtggttacagtttgggttcttgcctcaaggcctggtttttctctttttggagtaaagttatctgaagacctctttttctaagagaagaaactaatgggtcaaaatggaccctgggggatgtcagggactacagtgaaggcagacgttagttcacccctgaaataaatttctgtccagtgtgcagacagtagccagcagacctttgtctccatcatccaataccagtcttttcagatctagtcaatgatctatttaaagccaaaatatccttatgagactgtcaaatagtattgtatttttttgtatcactcgtcaagaatagcttagtacccggcaataaattttatagtactgatattaatagatctcaggtgaaagaaaagtcatgtgtcttataagatgggtgaaagccacctccaaatagatactctgttctctagttgtttttcatgttctattcctctgtaagttcagttacaaaagctgacttccacaaaaagttctccagtattgttttggaaccttattttctaatatcttgtcatatacgagttgagtcccaattaatgattcattatgaggaactggaaacgagaaactgagtggctcaccaaggaaaatatgtgcaaacctaacggacaatttggttatatgatttaaccactgcatgcataaattataactaggtattggactcatactgaggagtgattaaaatgtaactatgccttataagcaacataattaaatgtagctttaagccagataggcaagaaaataacaaaaggacgcagattaaaacatgacaatatatggtattgttctatgagtcttgagtggaaactctacatttcatgcagtcatctacttgggctaaaaatcatgtgtagtggccatctccttccaaagaccatcttacttctaatgagttctcattgaggtctcacgttctcagtctgaggtctccaggtctcaagatttctcagcttgaggtctccagtaatgatttaagatggtttatgcctctttgattggaagacatcactctcagtatcaactccctggaattttacttctggatgagtcgttaacagtatccgatagggtcttttccatcagggttcgagggctttctttctcaggtatctctcctggagatacctgagaccaagcctctgaatttagaccatgtgagggtcatttagtagaggaaaagctgcttgtttacctcttaataagactggataaattgcctgagttacctgcaatatttggctgtgatcacttccaataatgtagagtctagaagcagaggagatattcctagactcgtgggttggcctgttgctaactcaaaagggaagatttgatgaaccccagaagttgagctcattgtcattaaagcaaacattaggccatgtgagtttgagagtctttgatagttttgctaatttgagcttaaactttttgtttattctttctatatttcctgaagattagagtaatatggacagcagcgtttctgtgtggactggcagagctgtacaaagctctttatcatctcagtaaaatggagatagtttatacttgtactagagagagagtttgggaacataaaatcatgtcaaattttgctctggcagagctggaaatctccaaacaaggcctcaatctatcctccaaataagcgaacaattaccatacatactcaaaacccattgcagaaggtacttacaaaatctgtaagtgttctaaggggccctgagattcttgttcatgccccatctttgcatttttaccaagattatactggtaacaaataagacaccgcatgcaacctcaataatcttagtgaaatttctccatcaatgttgattgagtgcagtagccaatttttctttgcttaggtagttaattgcatattaaatgtttgaaacatcccgtttaaggtcctctggcgctactaagcatctatcctagagtgtgagagattttcctcttgcaatttacctgcagatttatattagtaacggtttgccaactgtggaaccaattgttgacattctataagaacctgtttgaacccgtcagaaggtttgattatgaggaccaggatcttagtgagggctccatgctggggcctcctggtatccccatcttgtattagtgtttgtttttttaatagccacatctttagcaagctttacaatactcaaaagttcttttatttgctgaccatttttagtagaggctcctgctgagattgagaactctgtttgttcacaaacaagaccaagaactacacacaaagcatacctgccaccagcactctcctatctcactcaaactgaccagatctgtagagcgaaatgagtcctgtcatctggcagattttgcctctggtagtgattataagggtgaagtatgtcacatcatgtgccatctgatattcttttgtcccagtcttaaagtacagcacatcaaagaacaagatgaaacatggatttttaaaaagagattactaatacatctatttagggcatagtttgtaaacaaagacagtacacagcttcttcttaaggtaatggaaaaagtagcaattttgaaagtattgccataagtaataaagatgtgaggtgctgatgtgaagtaatatttcataggaatttaagcctctatgctgaaaagtatgtattttcaattttgtgtattttcagtaaaggttatccagcaagagggactatgaaacttaaaggagaccctaacctaaaccaagccagcagaggcttccagtaatttagctgttgtggctattgccactgggtgaagatacagacttcaatgagctggcccctgaggattctcctgaaatgcatttagaacaccaagagcttatccccagcactcatatacaaactggtagagagttctgtgataattaggtaggcctaaagtgggaggtcattggaaggctaattttaactcacaaaaatctctttgtgattaggttcttagggctcagttttggctactcataaagtgggtaagtcagagagatgggaaattttggaaaattttggaatgttctgcaataagcatccaaggaaacccaggaatcctcttaatgatctcttaactactagcctgaaaagttttggatagcttataatctatcaggcataaaggattcatcttcttgggataaatcacatcataggtaacgaacttaaacaaaattctaacttctctttggaaattgtatgacctttctgagctaaaacaaagtagataggtagaataagtcttagaacttgctttgtctttagaacacagtcactggtcattcatattatctattgataagagtggaatcacagaaatttagggtccttgaaatcgttgtgaaaagtaggaaggtatctaagtaaatccaggggatatagtacaagtatgctgttgattttgcctagggtgtaccaacaagtatagagtattttaatacaaaggcactataacaaaaaagtagaacacaaatctgccactataagatatgcagcctcaaggactcagtggaaataagatggtatttgggtggggtatgataaacagcgattattctatttatggttctgaagtcctgaaaaaatctgctatctctgccactgggtttttgagcatggagtgtaaaagaattataagggctgttacaaagtttttagctattattttagtcctttagtcctttttaatctcttggttttagaagagattgtgcaagttgggtagcagttaaggtggataaatctgagtcttaaccgggtttatccataagaatgtcaagcacttccttgagatcttcaattttggcttgatttagattcaatagtagtcgtgaatcaatgtccagattatctatggtttctttatgagtgagggagtcagagactcaaggtctagaccatccagatagcatttaatttacagttccacccacgtagtaacttcctacctatcatgtgagtgaatatggtattacagagaaagaaagagtgtaatttagttaaagtccaagggtggctgtaatgggctgggatgtgaggaatatttgataattattgcagaaacctaccatgtgagtagtttattttcaatgaagaggttgtgtaatagtgataaggtttaaggttgatgatatttagcacccatatcagttaaaaaaatttgcagagttgtcatttaatatttagagaaagttttctttttgacttgaaagatgaaatgttttgtgcttgatacccaccggaagcaccttgatttgtcacttatttcatgttttgccctttgattctgagctaatgcaaaacaagtgttttccaatttccttactgcttacaggcgtctttatcaagagacttccttattccgggtttaatgtctgggataggaggatgtaattttatctctactttgattttttttaatgaaactctttcaaaatgtttagtgaggtgctagagatctgataatgggaataatattgctcattgtagtttttttttacatattaaatcctgtttttttggcttcagttcctttctgcaaaatggggaaagatgtgtgtgggctcatatctgcttcaaggtctactgagtccttcctaagggtattaaagagcctatcttcaatttctccaatggacacatcctttctttgcttgcaggactggattataaaacaatctattttcacagggaagactttaggggtagtctccaaaagaccttgtccaatatcttcagtttttctaaaattctttgtttcctgtaaaatttgaaactctttggtttcctgtggtcttttatgtcaccactgagactgacccattttgcctttttcatgtacttttttgcatctagggttatcactaaaatatgaactccttggtatagatttgggagccctggattctaacttcctaaagatgttttataatcctcgcaagttttcctctattctgcctgtgctttgaagagcctttgacggggtctctcatctcagagttagatggcttaaaatcaaccacagatgtttccctgttgtgagggtagtttaacatgaagaggtcattgagctttggggttttctggctgtctgaaagagaagaaaaattgttcagagggagagatgggggagagaataataataggataaagtctatttggtttgagttatgatttgttggtatctaaaacagagagagagttttttttttcttttgccctggctaacaaatttcataagaaagcagttttgaaatctgaattgcctttggatgtttctcagattaattaaaaatgtagactactggatgtttgaaattttgatctatttttattttaatgtactcttaaaaaattttgttcatagaaaaacttcccccaaagtggctgctataattgtaactcatctctgttgaaattatgccatttaaataagtatatgaatgtggattatcttataaacatatggaagaagaagtccagagggcgtttggaattagaatgagactggaggcataccctgaaagtgtggtaaaactctgaaaaaaatgttgcttatgaccccttgggtctctcaacctgatttctacattgtctaactgtagacctgaaggaatttgcagtttcttgggggtacataagatgttaataggggatttctcttagaaccagactgatgatcaagacaagattgaggaaaattgtcataggttttgataaggacctagggaaaaatttctccaaaggacagcaggctgagaagaaatcttacaaacttctccatccctggggctgtcttgagggatccacttacctgggtctctctcactctcttccctatgaacattccttatatatacacatgaagtggcaaagacaaaggcgaagagtagcatcactagtaataaggcagtttcaccaaagataaatttttttcaagtctgatcaaagtgttcctgaaaagagttccttacccttaggagacaaaataatctcagtatactgggagttcaatgaaaatatactggggctcagtccaatttgatttacttaatacactgttgcactaagagatagtcctgaccaggaagctaaaaggatatctgaggaggacaatgaattaaggttctgaattaaggttcttgtgcctaggctgcaaagaggtctcaatctttatggatcttggtgagatctccaagattgttcaatactgaattcctagaaatacaacctgaagaatattttgataaggcaaagctgagtttattcttaatgtggtaagagaaagcaatcccctaatagatattaataacattttggacaaggaaggacaaagttagaatatttatgagactttaaaggctcatttaagatgggtctttaaatgccagggcttgattaggatttggcgaggattatgataaaagagtttactgttggtggacacagcaaagtaaagatttggaggtgagggattcaaaaactcttagaatataagctattgtctgatgttttctactgatgagttaataagtttctaaggaagttcttgtaataaataataaacattattcacaacttttatttttctgagcaagaatttactggaatagtaaagtgaaaatagtgccagtgaaaatagtggaaaatttaaattggaggcaattagccatgagagtgtacatgattttgtttctcacagtgtcagttaacatttcccctctgtgcaaatccttcaatagtttacaatttgtttataataaatgtccgtagaatggcccacaaaactggacctggtcaagccactttctgtcacctcttacctcttagctactacttgctgttctggaaccactgggccagcttctgcaccagattctctcttggccccaagcatttttccaccgtctctctctctctgcttactcctctgccatcatcagttgtcaactaggctaacctggtacacttctctaagtatcaatatcactacaatgttgctctttacccctttccactattttcaacactgatcatgtaatataaaatattatttaatattttaaatgattatccatctccttgcactagaatgtaaacatgctgactgtagagatttttgtctttgtcttttactgctccaacaccaattctctgactttgaaggcaataaaaactgactttaaacctgaaaagaaagagctaaattgccttccagttctttgaagtaaaagtttatacttcaaaagaattgctctggaaagggagaaactgcaagagaaatttcaacttcttgcttctcaaagagaaaggcaaaattatataaaattttgaggaagggtggcatttaggttaaatttataataaacagtatagctgggttagatggaagcaaatggagttggtcagatggggttgatttgatcaaagccaagtggaaatgattggaaggattagagagcagaccagtacaagcagtgcttgctgatgtggacatttaagtgaaaactcattttgaccaattttgcagcttcctgagtatggggtgaggatatcctgttctttaggggataataagattttcagcttcttttgtacatgtgatgatgcctttaggcaagggtgatatttttcattctcatgaccaaagcacagaccataagtctgaacacagaacactatacatggtaatctaggtactctatttgcctttgtaggtgattgcaattttttccttatttaaaattttaagaccataaagaatacttgaaaagtaactttttaccaatcatttaaaaaatactgattaaatgataaaatcccttaaaaacacagttaatgcaaaagccacaaaaagaaatataaaatatagctttacatctgttaaagacactgaacacataattaaaatattcccaaacaacaatgctccatgctgaaatgttccactagtaaatttttacaaatatttaagggaaaaatgtataattttcattttctcaggatagctgacttctagtaactaaacatgacaaagaactataaaaattgaatttacagaacatggctactaggaatatagatccaagtagcctgaacacaataatagtaaatcaaattatgtgaatttttttttttttgagatggagtcttgctctcttgcccatgttggagtgcagtggcacgatctctgctcactacaaccttacaacctccacatcccaggttcaagtgatcctcctgcctcagccccactagtagctgggattacaggcacttgccaccatgccagtttaatttttgtatttttagtagagacagggttttgccatgctggccaggctggtcttgaactcccgacctcaggtgatccacctgcctcggcctcccaaagtgctgggattataggcatgagccaccgcacccagccaaaatatttttttaaaaggtcactgcattataatcatttggggtttacttgagaaatgaagattttttttttaaacattcaaaaaatcattcaacacttctggtttcagctctgatatgtgaggaacttgtaagttataattactgtccttataacaagataaagcagaacaaattgaaaaaaaaatcaattatttcctttaacccatcagagaactgaggcttcagggaaagttgccaccccaaagtctggggacaccgattgatacacagctgaaatttgcttagctggaacagaagccactggagccacaaattgataggaacatttaaatagcaatttagatgaatagctgggctgaatgtgggctagagtgaaaggaagaaactcctgggaacccccacatttttgtgggttctacctccagaacctcaacaatttctcatggtaaagatttaagaaagatcccctcctcctttggaaagggagagaagagtaatcattgtgaaatacacccagagcattcttcataacaaagacctaacctccaggggaaaaattttatctgagccatatctcagtaagggataaggggaagggcattcctttcatttcagccttctctagctttcctgttttaccaatcaggaaataaaaaacccacaattgtcaatagagatcagcacttcaaggaaatagattggaagcaaaagaaggagggaaaagagtagagaggtcaggtggagttgagggagaggttctgccactgaaggaatgtttgtgatggttgtaacaccaagacacaggcacacagagacttattcaaaagatcatagaacactctcccctatgtcttacgaccccaccagcagtgttctgtgtaatagtagattacagttgaaatagctgtaagacaccaattctctcagaggagtacttagggaagtccaaagtcaagagcagaaacaaaagacactagaggaatttggcatttctggtgcctctagtaacagcaaacattaaacaaagcccaattcctcatcagatttctgtaaatagcattctaaagctccatttacctcagtacttactaccagatacagttcaacaaaaaattacaatgcacatcctatgacaagaaaaaacagtctgaagagagaaagcaattagcagaaccagactcagaacaaagatgttggaattaataatagagatttaaaataactatgattaatatgttaaggactcttagacatgcaaaaatagattatataagcagagagatggaaactcaaaagaagcaagaggaaatgctagaaataaaaaacactataacataaatgaagaatgccttcaacaggctcgtaagtagattcagcacagccgaggaaagattcagtgatcttgaagttaggtcaatagaaattttgcaaactaaaatgcaaatacagaaaaagaaaagaatgaagaaaatgggacagaacatccaagaactgtggaacaatttttaaaggtgcaacatagatgtaatggggatactaaaagaatggagtatagagcataatatatgtttgaagtaaaaatggccaagaatttttcaaaattaataacagacaccaaaccacaggcccagaaatctcagagaacacaaaacagtaaaaatgcaaaaaaagcaaaaacaaaaacaataaaacctacaaatatcatattcaacctgcggaaagacaaacacagaaaaagaaatctttaaagaaggtagataaaacatcctcgtcttctcatcaggaaaaaaaatccgaaagtagtaatgtggtagtcaattatggcatatggatgtgtgaaaacaatggcagcaatgccaccagagataggaaaaaaaatggaaatcctctgttataaggcacctgcactaagcgtgaagtggtatggtgtaatttgaagatgggtttagattagttaaaaatgtatattgtagccagggtgacatagcaaaacccagtcttaactaacaatacaaaaattagccaggtgtggtggcacacatctgtagttccagctacttgggaggctgaggtgggaaagttgcttgagcccgggaggcagaggttgcagtgagccgagattgcacccctgtactccagcctgggtgatacagcaagaccctgtctcaaaacaaacaaacaaacagaaatgtatattgtaagttctagctcaaccagttaaacaaataagaaaagataattgatatgctaagaaaggagataaaatggaatcatgtaacatgatcaagtaaaagtagagaacacagtaaaatagaggtcttaaagaaatagtaatgcaatgactagaaagcagttgcaaacatggaatatattgatccaactgtataaataatcacttcagatgtgaattatctacattgaaaaacagaaactctcagaatggactaagacaagaccaaactaaatggctacaagaagcctactttaaaattaaagatttggatactctgaaagtaaagggatggagaaagatataacatgcttacagtaatcaaaagacagctggagtagctatattgattttcagacacagcagaattcagaacaaggaaggttaccaggcatgaaaagtggcaatacatagtgagaaagggccaattctacaagaatatctaaacgtgtatgcacctattaacagtgtcaagatatacatgaggtaaaagttgataaaactgaaaaaagaaatagataaaccctatttatagtcagaggttccaacatccctctggcatagacataaataagaatattgataacctgaacagcattatcagttaagttgtttgatgtttatagagtactccaacaacagaagaatttacatgaatatacattattccaaagtttacatgaaatattcatgaaaacatcatattatgtgccataaaacaaatttaaaagattataaatcatactaagtactcaggtcacaatgtaataaaactagaaaccaataaagaaagacatagctgggaaatctccaaatatttggaaactaaacaacaaacttgtatataatagacacatcaaagaacaagtcattagagaaattaaaaattattttgaactaattccagctggacaatactggttacaatttgtgggatgcagctaaagtagtgcttgcaaggaaatttttagcattaaatacattaaaaagaaaaagaccaataatcaatctgaccttccaccttagaaaaatacagaacagtttaagcaaacagaagaaccttaagcaaacagaagacaagaaataataaaagaataaaaatcaatgaaatttaaaacagaaaaacagtatggaaaaccaagaaaaccaaaagttgatttgtttaaaagattggtaacattgctaaacttctagtcaggctaagcaaagaaaagaaaaaagacaaatgaccaatatcaggagtaaaggaggggacatcagtattgatcccatggacgtgaaaaggataacagaatactaagaacaactctatgcctccagatttgataaatgaaatggaccaataccttgaagtaaactaccacaacctccaaaaggaaaaataggtaacctgaatagcaatatatctattaatgaaattgaaataataattaaccttcccccaaaatagcaccatgcccagagagttttactagtgatttttactaaacatttaaggaagatgcaataccagttctccaccattacttccagaaaatagaaacagagggaagacttcccaactcattacatcacaccatcattaccctaacataataaccagataaaaacattaaaagaaagaaaaactacagaccaatatctctcatgaagattgacgtaaaactccttgacaaaatattatcaaatcgaattcaacaatgtatagaaaaaattagtaccattatgtacattatgggatttattccaggtatgcaaggctctttgaacattcaaaattcagccaatgtagtagaccgtatcaatagcctacagaagaaaaattatattattatatcaatagatgcagtaaaagcatttcacaaaattgaatattcatgatttttaaaatctcagcaatctaggaatacaaggaaatttcctcaacttgatgaaaaaattctacaaaaaaccccatagctaatatcatactgaaatgtaagagactgtatgttaatttcaggagcaaggcgaggatgtcctccaattctatgcaacatcatactggaagtcttagctagtgcaacaagacaagaaaagggaatgaggcatacagattgtgatggaagaaataaaacagtctttactcaaggatgacatggagaaaatcccaaagaatccacaaaagaaaaacttggagctaataagtgagtataacaaagttaaaggatataaggttgatatacaaaaaccaattgcttacctataaaccagtaatagtctattgaaattagaaaaaaactataatagcaccataacaaaagcaaataaaacccttacttataaacctaaagaaaaacaggttcaggatctatatgtctatatgtagaagactataaaactttgataagagaaatcaaagaagatcaaaataaatgaacagatatatcctgtatccatagatagaagactcaatattataaaaatgtcagttcttcctaactttatagactcaattcaattctattcaaaatcccagcaggctattttgtagatgttgacaaagaataaccaacataacactgaagaagcacaaagacagaggagaaatactacctgattttaagacttttactagaagctgcagtaatcaagactttgtggtactggcaaaagaacagatacataagttaatagtacagaatagagagcccagaaatagacaccacacaaatataattaactgacctgtgtcagggaacaaagacaatccaatgcataaaagaatagtcttttcagttaatggtgctgcaacaaggagatgtctgtatgtgaaaaagtgaacctagacataggttttagatatttcacaaaaattaactcaaaatagaccatagaactaaatatgaaatgcaaagtgttaataattctaaaagaatacaagagaaaatgtatttgatcttgggttttgtgatggggaacaccaaagacacagaccatgaagggaaaaaaatggtaagcttttaaaatataagttctgtttggaaaaaggcacttaattaaaagataagccacagattgggggaaaatattttcaaagtacatatctaataaaggtattctagtcaactgtatagagaactcttaaaactcagcaataagaaaacaaatgaccaattaaaaaataggcaaaagatctgaacagacaccataccaaaaaacaaaaacaaatacaaatgataaatacacttatgtaaagatgcttaacattttctgtcactggagataaaaaataataaaataccactacacatgtactcatatacatgtacacagtacacatatacactacacacagtacacatgtattcccatgtaatagaatggctaaaatccatccaaagcctgatcatgccaacttctgttgaaaaggcaagcaacattaattggtgatggaaatgcaaaatagcacagccacttttgaagacagtttggcagtttcttagaaagctaaatgttgtcctgccatatatctagccactacgctccttggtatttacccaactaatctgaaaacttacgtccacataaatgccagcacatgaatattacagctttattcataatgaccaaaacctgaaattaactaaaatatcattcaataggtggatggataaactgtgatacatttatacaatagaatactatcaagcaataaaaaggattaacccatcaagccacacaaaaacatggataaatcatagatgcatattgctgagtaaaagaagccaatctgaaaagaatacatacaatattcttcatttttgtaacattctgggcaaggcaaaactatagatatcaatggttggcagggttcaggcgaaggggcagggatttaatagataaatcacagcaaatctattctgtatggtactgtaatagtgtatacattatactgtgcgtttgtcaaaacacagtgaactttaaagcacaaatgaaccttaatgtacacaaattttaaaaaatcatttaggagtttgggggatccaagatggaacacagtgtctgacaaaagaatccaggtgttttacaaatgtattagacaagcttacgaataatgttggggagaaaagataatgacttaagtaactttgaaaatgagtggaatctgttaagactagaggcaaagtgactgtacaggagcactgcacactatttgataaagttgttttctgtaggtgtatgagttagcaattctaaatcatgatacatatgtatattggaattgaacaattaagtaaatggttggcagatggtgtacattttcttattgttggaatgaaaagttacagacaagaagaaaagaatgatttgtgttgtaatggattagagttggaaacgtcagtgtaaacttatgtttagtttaatatgcagacagatggttacacatagaaatatagatgcatgtatttacatagttattgtacacaccctgtgtcaactgagaatgcttagaagcaatgacactctagtaacaatgggcacacctagaacccagcccttagtttctaataccattctccaatagaacaaatcagggatccttgtagaaatggctgattctaagactggttaggaaatgtacaagatgagcctggagcatcatatagtgccagagagtaaggaagtactaaaacaagaaccccacattgatgaaagtatatcaaagggactcaggaaccaaccaaaagagcttccagtggtcaaatctggaacaaatttttaaaaataaatagcataatattagattacaacccaaagtataaaatatccatgaatccatattgatgtaaataatcaaatgaataaataaactggggagaacatagattttttgtgcagaataatttcatatagtttttatagatacttttgcccttaaggaggttgaactccttactcgtcaagtgtgggaagaaagtcattaggcacattggtgactttctttcaaagagtacagggtggaaatgggggatggaagggaagagtaactgtgcaggggagaaacctgacaagcactatctctacatggtaatcaaggttaacatcagtagtgataaatcatgctgatagtatatacctttgatatgacgtgataaaaattgcactttacctctacagtcttcctcccaaaaacccataagatcagtatcattatgagaaaaatcatcaaacaaatcccacatgagatatactctacaaaatacttgactagttttgctcaaaactgtgaaggtcctcaaaaaggaaagcttgagaaagtgtgacagtcaagaagagcctaaatagacaagacaactaaatggaatatggcatcctatatgggatcctagaagagtaatagtacattatgtaaaactatggaaatctgaataaagtgggctttagttaataataatctatcaatattggttcgttgagtgtgacaaatgtgccatattaatacaagatgttaacaggaggggaaactgggtatagggtatttgggaactctgtttcagcttcactttttaaaaaatcttcaaatgtttacttcaaaaatgaattcaaaatcactcaatgtaaatcactatggtaacataagagagaagaaaagttatatgatcatctcaaaagagaaaaagcatttgataaaatataaaaactattctttataaatctctttattggaactacgaatttatgggaactaaaaattgaaaaaaatttaatgagataaagggtatttacaaaataaattaattgtaaaattattgacagtggagatagagaaagcttttttatgagattgggaataaaagaggattttttttcatcatttctattcattactatactggatgtcctaactaggggagtagagtcatagaataaggattggaaatggaaaggtataagtttcattatttactgacaagaaacaagtctgaacatgatcaattaaaattaggaagttaattgagcaagattgctgggttaaaaagcagataactaaaatgtatttctatgtaaaatgacaaatgaaaaatgaagtttttaaaagataacatttttgggaacatcagaaacatcaattccataggaaaaaattcacacaaaatattatgaaacattatggaaaggaagcaagtaataccttacaaatggagggatataatatattcacagtggcaaattcaattacatatactatacatgttaattctcccccaaattcacttaaagatcccaacgtaagagcattctaaatctgaatgccatttattaaatgttcaatctaatttcaagaattatatatgacacaaaaagtcaagaagagccaagatagtcttgatgaagatgacaattttgcatgagttacatggccaaaatttaaggcctactattgcaaggttacagttactgacaaaagacagaaaactagcctaatggagcaaaatagagactccactccacaagcagatcaatagatatatgattacttgctttatgataaaagtgccactcctgcatgatgaggaaagaatggtttgttcaatagttagtgctggatatcaatacataaaaaagtgaattccttttcaaaccatacagatccatcatttctaggtgtaatgttggtctattcatgaaaggcaaaacagtaaagcttcttgagcatagcataacataggagggtgtcatcataatttggcagaaagtgaaaaataccaataacactaagcataaaggaaaatattgatgaattagtctgcatccaaattaaaatttttatttctcaaagtatataatcagtgaagaagcatcgtataaaagatacaacttgtacatgtcaaaaagttagaaaacacttaaatgggtacttcacaaaagaggatatctgaatggccaataagcctatgaaaaggtattcaaggtcattagccatgagaaaaataattcagacaacaatcagataaacatcttccagtatatctagacagtccccaatttataatggtttgatttatgatttttccactttatgatgttgtgaaagtggtatgcattcagtagaaaccataccttggattttgaattttcatttcccgggctagccactggcagtatgatactctagtgaggctaggcagcagcagtgagccatagctcctagcagtcatgcagttatgaaggtaaacaaccaatacttcatcgcgtactgtgctgccaccattttgacccactgtaggctaatgtaagtgttctgagcacatttaaggtaggctaggcaaagctatgatgttcagtacattaggtgtactaaaagcattttttatttacagtgtttttaacttatagtaggtttattaggaggtaactccttcataaatcaaggatcatctgtttaaaatttgaaagtgtgtgttttttagaattctcttagtattcactgaagttgaatggaggcaacatactctcaggtatatggttaacaaaaattcatgcatgattgacccaaaatatgtatacatgaatgcttatcatggtgccatatctaatagcaaaaattgaaaacaaagtgcccaggaggagttgaaggataagtaaaccttaaaatatgcacatattctctcaaggaacgtggatagtattgtgactgattcttctccatgtgtgatccacatagatgataagatcatcatgagaagaacttaattttatacttgagctttgctttgactgaaagatgagaaattttgtgattattggtatcatctctatgatgtcatattacctagattcacatattcttaactccattaaaatagaaattatatttgtgggcggggaacttattttcatccatctctgtttccttccaattgagcaattccttattttatgttaacctgattttagtggttcattgccataattcttagaaattatatctcattttttcctgtgattttactgtattgaagtaaatctggttggcaggatatacaatattacatgaatgaaatttgcctttggtaactgagaaagttcaaatagaccttggttctagcgaagacttgtttctaaggaatttagattcattctttcagacagtatgaatatcattatggggtcttcttcatgagttatgtatgtgatgggattcttgtaagattttcaccttttacctgagcttgccttgactgaaagttgagaaaattttgtgattcattggtataatttctacagtgcaatatttatttggatctaagcatgcaagtaaaaaaattcatccctgttatagtatttcaggtttgcagtacgttatgacatttgtagatcattgatggactatgaatattcaagggacctggcaattgtacccaggggattgagatccagatacttgtttgtttgcccatagatataaaattaggagcttcctgatatctaatttacttttttaggaataacacccatgagatacagttctcatctactgccctactcctgtccttagataaataacaccggaagaagaagactctctggcctcttacatcagggacacatgaaaagccacactgaatatgtatgaactccaatatactttcacagaagggtttaaggatgccatccctggttataatttttaggaccaaatatatatatatatacacacatacacacacatttaggatagatatatatttaggatatataggataaatatatatatttagtgccatggtttgggtcatgaggaggtttgatgacataaaaattatgctcataagtattatgctgagacccattcttgggaggagatgtgggggtgtcctaggctgtgcaaaacatagctatggaaacagaagttattaagagaaaagaacaagcagtcagtgagaatttagataagagactgtaatagaataaaagtatcagattagtgaatggttgtcctagtaatttggaagaaaaggaataaaaaatggagtcagactactaaatggcaaaaataaagacttgaagaacttaattttatacctgagctttgctttgattgaaagttgagaaatcttgtgatttgtcggtatcatcatctcaaatcaacttatttttcatctcaacatgaagaatatcagctctagccttttggaatttcagcaactcagatgcttgttagaacttatccaggactgcttgcaggacccaaaatactaataatccatatgcctttttttccagctgaaattagctgtcttaagagttgtttttcagtgctctgaggatatccacaaatatatcccaaggcactctgaagtgtgttttcaatctttggccctgcacactggggatgcccactggatgttgcatggagtgttgcctccagttgactttgatagacacaataaacaccacgtgagagccccctcatgaaggagggctgaggacttggagtccaattctccacctcccctgacagataggctattcaatgccttgggaatccgacatgaaggactgcttatagcagtccttgaaaactttctacagaatgtgaactgggagaagctaaatgctgtactcacaagctgggtgacttctccattgatttttaccatagctcactgaaacattttctaaattaacaggtataaattcacagacagatcagaatagatccttggtcctttccatttttctggcacttttgttgccaggaattcaaatacaactaagagaaaaagtgggtagctagcaagaacagatagtttctcaaatattagtggcagtaacccaactttgagaaaatatggagaaagagaagaaaaaacccttaagactgcagtgttagctgcccagttacaattattcacaaagtgagcaaatacttatttgggccaccaataaataagagggcacaagctaacgggaaattaatacgtcactcatgtaaaaagtcaacacattagaaaaaggaatcttggatgagattgagaaagatgcaagggataaaacctgacaagctttacaacctccttgaggaggtcttccctactctgtaaaatcagacagaaaatcattggcaaatggagcaaagcatgggcaaaactgatataatgaggaaacagagctgggaaaggataaatttatgtgtctgtttctgtttcctatcttttaatccttttttaccctttcttctggatactggagcaacgtattctgcaatttctacaggccttttctgttttatcctaaactaggaaaatatccagatataagtatttctggactatctgctacctcttctttctcctctgaggttttcatgcaaataggcgaggtcctatttgcataaaataggaagaatatgccttgtctcctaatatgcccaataatcttttaagaaagggcctgctgtgtaaaccaagggctatgatcttctgtactctgaagagagtgcttttggagcttctgggatgcaaggtatctacattgctaaatatgtgctttctgaaacaaaagatggctgtgggagagtaggagtctcactcaatgctggagaagcactcccaagttacagaaaataaacccatatctatgagtcctaggaacaaatgataaagatttaacaaaagagatcaataccattgttgtaacttacaacagagaaaaaccttggccatgtatagaacattttctctatttttacctcaaatatgatgtaattagaaaaattttaaaaaacgtggcatagttaaaaaaaaatggcacattcacttcataatgcttccatattgcctgtgggaaagttaggaaaacttgacagggaaggtcaaactgtttatagatttatgcatgatcttagagaaacaagttgtgattcctctgacacttgtaattcccagccttgccactgttttaatatctgttcctgagttatctaagtatttttctgtcatggatttatgttcaatgttttgttctccatgtttagctggggagtcgaggttcctgtttgagtttacctgtggagcgggaggctttcaatatttgtggcaacggatcttcctggaattcagagagtcacctactccattctctgggcatttataagaaaatataaagaatattcctcacattaggattccatactaattgttattgatagctgctaataacttacatgctagtaaagaagacattttagctttactaaatttcttagactcccaggacgtaaaacctcgctagctaagttgcaatattaccaactgaagtaaaatatttgggatctgtgttattggcagatggaaggtggttgcatcttgaagtcagcctaatatacaaatgaaacaacatgccaaaaaaaaacttcaccgattttgaggattaattgtagatctttgcgttttatgaaaaggctaagcctctcactgagatgttacatgaaacatcactagaactctttattaaagtcaaaataaggctgaagaagtcttttatgcccttaaaatagctgctatttcttcacttgtattacttttttaaccttgttaaaaaaggagttctaccttttctgtcttgagattaagggttactccaaaattaggccttgattataggcacattgcttactttcccaggttcttgtattttgtctctctggaaatgcgatgatatttataaggtacagtggcaaccactcccctgattaaaaaggctcattcagtccttgactctgagaaatttaacttacttacaggtacttcatgttgttactgctattttacaagttcataagacacaacacttgtcagtatgctgtcaaacgagctaagaacaagtcttattgtgtgatcctaatgctattctaggaaggtgtaaccttttgacagctattctgtggccagatcttgacagaataagttgaacttgactgtctcagagtgattgaggaagacactggagcatggtctaatttttgtaatattcctattcccaatgttgactgaatattcatgaatatattctgtgtgaaagacccacaaaggaatataaaagcatgttctacggtaatcaaccctcatgaagcttagaggcttctgtttttcgaaacataaaatcagcccaagtggcagaattgtagttattataccagctgttaaattagccaccagttataaagcagatatctatactggtaataactatatgtttgtggtctgttatgtgactagccaactttggaagaatagatgctaacgtcaataggaactaaaatattacatgagaagctaatttctgatttagtagagtcattcaaacttctctaacagatttatgtaatttattgtagagctcacagtggaaaacaagattaactctttaaaaagaaattaatttgcagacctagctgtgaagggcttctgacgtttagactggggaaatcaaacctctatcacttctgtccaaaacctcctattcataatttcagaaatagccaactctcttaagaattagaaaattaggaatgaaggagaactaagatgaacaccataggaaaatgagaattacataatgaaatctttcctttattccgattgttatatgattgagtggctttttcatgccaccaacaagttcgttcaagcaaaaggaatatgctgacaacttgaaatctttgtaatagcatcatataattcaggaaataatatgaagatatgctctttgtcagaaaaattctttccttacctaaaataagtcaagaaagcctactaaggcccatgatacctaggatctgctggcacaagaactttatagaacttccacctttagaagatagtaaatatttttaccagtgttgtgtattggtgtctggataggctaaagcagatgctcaaacagtgatcaagctcttactgaatcatatcatctcaaccactggaattcctgaatatctggaattcagtaggggaatcattctgtatttgtgggaattcgggaattttgtaatactctacaaataccaataatttacctacctgttatccccagtcttctgaacaagtggaatgagtgaaccacataccctaaagaattatttagctgaattatttagctaagttatgtaaaaccttaccatccgtttcatttaaaataagattaaatccctctagcaagcccaacattactccctttgagtttggaaggtctactaatcttgggcttaagcctaaccctttctctgatacaatggaaaatcctcatgaccatatatgatacttaaagagtttgtgggtttccctaggctcaccttgccaacatgtggccagatgctgaaaaagccgcctggggaagtgtgtcattgatattgaacaggagattcagtctatatcaaagtgttctgatgacagactgtgaccacactggacagaaccctatcaagtgtggttgagaattcatagtgctatcaagatgaaggagaaacccaagtggatacacgcttcacatgtgagaccaacatccaccatcgagtggggtataattcccatttaggaccttaaggataaattctctagatagtaaccttgaataatatgcaagctaaagagaaaaacttatttgatagacagcaggagagatagactgttttgttattaatacgttcttcttaattattttgaccattataattttgatacttagtttgtattaattttgatacttagtttgtatcaattgaacataaagcttattattagtctttcttttaaaagttagtatctcaacctcaaggaattttgtggtaattaaaaattgtcctgaatatgagatcaggacttaagaaacccctttctttgtcataatacttcaaactcaccaactggatgatttaaattcagaagacatgaaaaatttcaaatcttcccactgattagtcaatattacaaaaatcttaaatatcatcaccctttgtgttattgaagatactgatgagaagaaatttttaactaattaagttgaacgtaattatattcaaattgaaagtccctgaagggtatcacaaaactccaacaactctgtatcttttttttttttgagcagagtttcaccttattgcccaggctagagtgcaatggcacgatcttggctcaccacaacctctgcctcccaggttcaagcgattctcctgcctcagcctcctgagtagctgggattatagacatgcaccaccatgcctggctaattttgtattttttgtagagatggggtttctccatgttggtcaggatggtctcaaacttccaacctcaggtgatccacccgcctttgactcccaaagtgctgggattacaggtgtaagccaccacgcccggcccaactctagatcttaaatagccatgggggtccaatttaataaagcttaaatagacacacagatgagaaaatatcccagcccaaatggtgagggttagtttcttcaaaacccccaaaacgtatcatcacctaaaaatgagcttaccctgtttagaacctggcagtctccagtccccatacttacaaactcgaggataattaaatggtctgtatcatttaatattacaatagctaatgtgagtaaactgaattctacttgtacatgataggctttaccactatgaaatgtttttacacagggactaaaatggcactatgatcaaactgaaagagatttctttttttaatagatggggtctggctttgttgcctacactggagtgcagtagcacaatcatagctgtctatcgcctgtaactcctgggctcaagggcttcctccgtctcagcttcctgagtagctgggactacagggacatgccaccatgcctgcctatttttttttgtagagtcagggtcttgctcaggctggtttcgaacttctggcctcaagtgatcctgctgcctcggccttccgaagcactgggttcgcagacataagccaccatacctggccagagattattaaatacagtattagggggaataaaactaggactacaattgtaaactcttctgatatagaaacaattactgataaacagtgcattggacaatttgcagaaagatgcaaacatgatagaatcaaaatctaaacaagatatgacaaagaaaaacaaaaatggaattgggaaagcatttggaattggacatctggtaataaaattctattgcaaaaaaatatatagtaaagaattttcagaagccttcacttgcattagtgcacaaccactggttattcaacaactacaatgtatacttgctggtactgaagtacaagattatacctactcagacaaacaattaggtattggacatactactgtctatgtagagattaaatgatagtgtaaaaaggttgatcatattataggtaaaagagctgaaatctggcattgcagattgaaatttctgaaaactgaaataataaaactaatttcactaaagtatgtacattttcttatttacatagtttataatgtgttatataattcatgaatcttcaaaagaaatatactgagctattcaataaaaatttacattacagctttaggccaccaagccccatctattgattatgtacttggtgtaaattggcggggggaacaaaacaagagtgaaaactgagcctcaaaatacaaagcatgtagcaaaacagactactaaaattattctcaatttctaagcccattatatgatgcaggagaattcttatgtgtaggtaataaagaatctgttcaaatatgcatcagtggtatgacagtttcaaataacccactgaactaggaaatattcaccaccaaggaggtcaggtatactgatttggtcaacctggatattgacatgggatgttcttacggattgacagctccacttgatgctatcctatcacaaaatattattacctgatgttgatataattaacaagtcaatacaaaaagtaaggtctctctacaagacaagactaacatctctgtaatataaatgggactctgagtgtaatagatttagggtttctgcaagaattttgaaagttaaggatccaacgcctgtaatcccagcactttgggaggccgagacgggtggatcacgaggtcaagagattgagaccatcctggccaacatggtgaaaccccgtctctaataaaaatacaaaaaaaaaaaaaaaatagctggacatggtggcacacacctgtaatccccgctactcgggaggctgaggcaggagaatcgcgtgaaccagggaggcagaggttgcagtgagccgagatcgtaccactgcactctggcctggcaacagagcgagactctgtctcaaaaaaacaggaaagcaaaagaaaaagttaaggatcctaccaacaaaattggaatatgagactgaggaaattcctattccagctaaacccagaattgattatgttgatgaacacatgaatttcatgtgtgtgaaaacatatgaactcctcattgtcagtctaatgagagtgaaaacaacacatcgaagatgcggggagacgacaatacagagtgggctcataactgcattctagatactgggattactttccattaaggtatataattttagaatatctcacaaatagcccatgcaaaatcctgcggaaaggcaaccataaatatagagagaatatgtaaaaaagtggcatggtctagtatatgccaaacaaggcaagggtatacaaaaacctcaaggtcccagtatgacaaatcatgcttgtattgcacacccattaaaaagtcttctaaaaagtttttttaatggtgtgcaggcaggtttattcagaaaaagctcggattcatacttgtaaaagtctgagaaaagcattaaaatgctattatgatacagttgacccaaacaacacaggtttgagctgtgcaggtccacttatctgtggattttcttctacctctgccactgagacagaaagacaaactcctcctgctcctcagactactcagcatgaagatgaggatgaagacctttaggatgattcacttcttcctaatgaatagtgaatgtattacttccttaataacgtttttttttctctagcttcttgtaagaatacagtatataatatatgcaacacaaaaaatacgtgttaatcaactgctttatgttatcagtaaggcttccagtcaatgggagactaactactaattaagtttttggggagtcaagttatatgcagattctccactgagcaaatgttcagcactcttaactcctgtggtgttcaagtgtcaactgtatatatgtttaagagttattgtttacccagtagatcaagccaagaccaagttaggtttatgtgtttttggcttaacctaagaaaatgttcagactaaagcagtccatcaatagaacagactgccttttaaaccagggaacaacttgtctttgtaggtattttaggtatatgaatgaccatatgtgatctgctttgggtcatctatggtcccttccaacttaaaacttctctattcatgaacattgcataactgaattgtggatttcatataaataatatcttgttgcctactttaggtttgaaatgttttccttctcagttgcatagatatgtatagcaccatccccactatgaactctcatgtagaaaataccagattctaaagtcatctgtgaggctaaatgtcagacttaggcacttccacataatgctgcaaaaagcaacagcttaaaggtattacttgctcaacatgtcattccaaacacatacactatgattagcagctgaatttaacagtatctttccactttgaaaaacactttatatacctttacaaagaagccatagtatctcagggtagaaaaactcaacaggtagaaaacatggccttctcttagaaatgagctacgtaattttgagtacttatctcaaaatcattgcagaaacatatctagtgcttatggaaaaagaatcaaaagatctttttttttagctaaagattttgagtttttcttgtgacatttaagtcttttaatgtatgctgatttttatgattatctaactgtttcataatggttattcttgcctccatgaaagggaagactagaacaaaaacctgacaagaacaagttctagctccatcaccgacttactgagtgaccctaggcaaatcatgtgggctctttcttgtgttttaagttttacctccaatgaagtaactgcctcagactagctgtgaagctctcataaagtgatggatttgaaaatgccttgcaaagaatgagcagttaatacatagaaagtttcatgtacttccgtatattgcatgatgcccacccagggttaggttgataacagttgttgatccaataatgaaagaaataaaaagaactctttaaaataacgaagtaaaatagctaattttcctgttgtagttttaaaaattatataaactatataactaaacatatttatgtttattatatataatatgatatgcaattacataagacattattatataatgtttttatataatgcttaagtaattaaacaattatatttaaatataagttatactttccttccccagataagacaaagaacctgtttacttctctgagggatttattggttcctgtgaaatctgtggaggccgctaacactccatagccagagaatgacaacatatgattttcttttcagtcttgtagtatccacagtagtgatgtctgtccatgtacaagtgtctgtccaggacatccattaaattccatgcctgctctgtgtgttatgagggcagggacagaagacagattcactggtggtactttcaaacaatgtggtaggccttccttttggggtctgccatgacaatgataccccaggcggcaatgctaaggcccatgaccatcttcataatggtccatggacccggggggtatcccatcttcatgggcttctgtgccacccagtacacatacccgcctgcccccatcagccgcaacccagaaagcacgtgacagctccagcaggtctccaacaggtggtgttctgctggtgaggtcggcgatccgggtgtagctggggttgcaggcttggcaggcacggcggcggtatcgggaggcacagcgatcttgagggactcaaaaggctgggacaactgagaccccgtgttctggaactcggcctccctaaaaattatgttttaaaaaatacatagaatcggtaagatgaggaaaaagcataaaacggtcaaaaacactgggataattcaaggttcattttgacaatggtaatacaaatagaaaaactgacaaaaaagaaaatacatcttacattagaaaacatacaagagtagttgtatacaaacgaagacacgtaccaaaaataagttacaaaatatgaatgcatatacataaaaaatgtagtttcaaacaattcaaaagtaaaatgatgcaagacattaaaatattcacaaacacgctcgaaaaataagagctgacgcccaaattagaccagttcaacggaagtgtggggtgtggttggggatccgccgcagaaatcacgtggcgcccaggccaaggctgcaatttcccatgctgcttggagaagacgcctgggagggctcccaccatgcccaggggcaggctatgtgactgcccggtctgcagctgtaagtggtttctgggccagtctctttgtctggtcatgacctggttggtggccctagcttgtgccgagtggtcccggagtggcccagggggttgtgtgtggggagccagcgtgggcagcggaggtgctccctggggcctgcagtagggcacagcctctgcatcttgtgtgagcccagtgacccgcctgtcctgtccttccagggttgggtggcagggagggccaagggtgccctgcgtccgtgacgggtcagcgtttccagcaaatgggtccatggagggagagcctagctgagccggcgggctctaccaccttcatgaggttctgtttggacacctgtcctactcctgttcccccagatggtgaccatggaggaagacttgtgttgggcccaatggccctcggccagtgtccgtctgccaggtgccagcccccggtgcgctgaagctcaggccattcctgatgccctggcctcctgcactgagctgtggtgagcccatccgggtcctgctggatacatgggcggggaggggggtgccctgggttgtgttgatgatgagaaccttatattatcctgaagagaggtgatgacttaaaaatcatgctcaataggattacgctgaggcccagcctaggtgagaattttggaagaggatgctgggatccagaggcccccgacggggccactgtatttcgggctgcagacctagaggccctgaagggcatctgaaggtggcccaagcctatctctgagcaaccccgtgaggcagtcaaggatccctgtgtgggcataggctggggctctggttccctaggggcagggcatgtgggtggctcctccctgacccccattctcccctgtgtctttcagtgagctcttctgcccaggcaggccccctggcattgaccggcataggtgagtggatcctgctggggtcatgggccatgagccaggctgctggggtcgccaagggtcagcctttgggacaggagggtttccttagggagccaacctgaatccccactggggagggctaggttctccaggagggcagcttccttgggagtctgacccaaggaggatatcttctctaaagccctgcagtggtgagggtggtccaggcagcaaagggttccttcaaccccacccaggacagcgcccagctgagactcagtgtgcaggtctggccatgaggactgcccaggtcacataagggggtccataggagctccggggcaccacaggggtcacacaggagctctccttccccagagaggggtgagcgattgggcctatggggtcaggcctttggagatcaaggattgggccccacccatgaacctgaatgggactgagcctttgagcaatggaccatcccagtggtgcctcggagcctagtcgggggtgatgtggcttcaagggggttgggtcaaggctgagctctggccggtgcctggtagtgctgcaggctggccctgggactcgctggctttgggcaaaggggccagcccgtgtcccactggaggtcaccccttccctgtgggcaactagcaggaagggtggcatccttagctgggaaggcccactgtcgagggtcctgtccagggaatttgcctcccaggcttcttctgatccacggactcacctccagggtggtggggtcttgggcccgaggaaaggagaagataccctgtgttccccagttggctgagtgtggcttggctctgtgtttgggaggtgtgtagggtatgaatggggacccaccagagaacacacatggcccagggccccaggttatgatttcccatgcacacttggagagaactctgggtgagtgccctccactcccaggcacaggctatgcaactgccaggtctgcagtggcatgtggcttccaggtcagcctccttggttggccatgagcaggttggttgccctgtcctgtgcccagtggtcttggagtggcccaggggtcctgcaggggagctggtgtgggtagtggaggtgcttgtggggcctgcaatagagcgcagcctaggtgccttgcacgagctcagtgacccacctgccctgtcctagtcctagctcagtgacccacccccgctttgcagtgatggggagtaccaagcgtctcctgcgtctgtgatgggtcagtgttcccatcacatgggtccatggagggagagcatgcatgagctggcaccacccaccaccttcccactatggaggcgtgaggccatgtttggacacatgtcttcttgtccccccagacagtgagcctggaggaagacttgccctggtcccactgtccctgggccagtgtccatcagccaggtgcccagaccccagtgcgctgaagctcagccctccctggcactctggtctcctgcactgagctgtggtgagcacatccaggtcctgctggatgtttgcatggggaggggctttccccgggttgggtcgatgatgagaagcttctgttttcttgaagagaggtgatgacttaaaaatcatgctcaataggattatgctgaggcccagcctaggtgagaattttggaagaggatgctgggatccccggcaggagggattttgggctggagacctggaggccctgaagggtatctgcaggggccccatccctgtctctgcacttgtctgtgaggcagcccagtttccctgtgtgggcttcgtgtcagtgctctggttccctggagcagggcacgtgggtggctcatccctgaagtcacgttctccctttgtgtctttcagtgagctcttccgcccatgagggccccctggccttgagcagcataggtgagcggatcctgctgggctcatggaccaggccacatggggtcactgagggtcagccttcaggacaggagggattcctcagggagacaacctgaatccccactggtgagggattggttctccaggagaaccacctccttgggaatctgacccaaggaggacaccttccctgaagccctgcaggagtgacagtggtccaggcaggaaagggttccattagtcccatgcagggcagctcccagctgagacttggtgctagggtctggcctcgaggactgcccaggccacatgaggcagggtctcaggctgctatttccagtgcatgcttggagagggagcctgggtaggccccctccctgtgcaggggcaggctgtgcatctgctggggctgcagcggtgcctgccttcaggaccagcctccttggttggcttgagctggatagtggccttggccccacccaggggtcatggtgcagcccaggaattgcaggggagctggcatggggagtggaggtgctccaggggcttgcagtagggcacagcctgggcatcttgcttgagcccagtgaccagcctgccctgttttccagggttcagtggcagggaggaccaagggtcccccacgtccatgactatcactgtttcacatggatcccatcaggtgggtccatggagggagagcatgtgtgagtcagcaccccctgcctcctttcccgcatggaggcatgaggttctgttcggacacttttccctgtctctccagatggtgaccctgaaggaggacttgtgttgggcccaatggcctggggccagtgtctgtcagccaggtgcccagcccctggcgtgctgaagtttgggcccttcctggtgccctgttctatcgggggaacccgcccccaataattcaacgtaggtccttttctattttccctaagtgtcggccggtctgagaaataaagggaaagagtacaaaagaaagaaattttaaagctgggtgtccgggggagacatcacatgtcggcaggttccatgatgccacccaagctgcaaaaccagcaagtttttattagtgattttcaaaggggagggagtgtacaaatagggtgtgggtcacagaaatcacatgcttcacaaggcaataaaatatcagaaggcaaatgagggcagagcaccagggccaaattgaaattgctaatgaagtttcgggcacgcattgtcattgataacatcttatcaggagacagggtttgagagcagacaaccggtctgaccaaaatttattaggcaggaatttcctcgtcctaataggcctaggagcgcttcgggagaccagggcttatttcatcccttatctacaactgtataagacagacattcccagagcggccattttagagacctccccctaggaaggcattctctttctcagggttgttccttgctgagaaaaataattcagcaatatttctcctattcgcttttgtaagaagagaaatatggctctgttccgcccggctctcaggcagtcaggcctgatggttgtctcccttgttccctgaacatcgctgttatcctgttcttttttcaaggtgcccagatttcatattgtttaaacacacatgttttacgaacaatttgtgcagtgaacgcaatcatcacagggtcctgaggcgaaatacatcctcagcttacgaagatgacgggattaagagattaaagtaaagacaggcataggaaataataagagtattgatttgggaagtgataaatgtccatgaaatcttcacaatttgtgttcttctgccatggcttcagcaggtccctccgtttggggtccctgacttccctcaacactggtctcttccactgagccttggtgagcccatctaggtcctactggatgcatgtgtggggaggggggtgccctgggttgggtcaatgatgagaaccttatattgtcctgaagagaggtgatgacttaaaaatcatgcttagtaggattacgctgaggcctagcctaggtgagaatgttggaagaggatactggatgctgaggtccctggctgagctactgtattttgggatggagatctggtgactctaagggcacctgaagggccagaccctgtctctatgaggcagcccaggctccctgtgcaggcttgctgttggcactctggttccctggggtgggacatattggtggctcctccctgagccctgttctccccttgtgtctttcagtgagctcttccaccaaggagggccccctggcattgactggcataggtgagtggatcctgctggtgtcatgggccatgggccaggccacgtggggtcaccaagggtcagccttcaggaaagaagggtttcctcagggagccaaactgaatccccactgggaagagatgggttctccaggagggcggcttcctgggaaacaggaaccaaggaggacgccttccctgaagccctgcaggggtgacggtggtccaggcaggaaagggttccttcaattccacccagggcagctcccagctgagtctcggtgctcgcgtctggactgccctgactatgtggggggccacaggggctctggggtgccttgggggtcacacaggtgctctttgtccctggagaaaggtgggtgatcaggcccatggagttgagcagtggagattcaaggattgcacctgacacatggtcctgaatggaacccaccctgttgagcaatgggccatcccatgggcctcttcaagcctgaagaggggcggtgctgtttcactgggtttaggtcaaggctgagctctggccggtgcctggtggtgctgcagtctagctgttggactcgtgggctttgggccagtggggcagcctgcatccctctggaagtcaccccttccctgtggctggaagttaccccttcccagtgggcgaatgtggggaagggtcacctcctgaagtgagaaggcccactattgagggtcctgtcctggcaatttgctgcccatgctgcttctgagccatggagacacctccagtgtggtgggatcttgggcccaaggaagggagaagacactgtgccccccgattagctgagtgtggccaggctgtgtgtttatgaggtgtgaggggcatggatggaaactcaccagagaaagcatgtggccctgggaccccaggtcgtggtttccagtatgtgcccagatacagcacatgggtgggtgcccaccatgcacagggactggctatgtgactgccagctgtgcagcagcatcaggcatatgggccagcctccttggttgacaatgaactggttgctggccctggcctgtgcccagtagtcctggggtgaccctggtgtcatacaggggagctggcatgtgtagtggaggtgcttgtggggcttgcagtagggcacagccctggcttctagcctgagcccagtgacctgcctgtcctatcctttcggtgttcagtggcggagagagcattgggtgccctgcatccatgatgggtaagtattccacatggatctcatcacatgggtccatggaaggtgagcatccctgagctggcacaccacaccttctgtccacatggaggggtgaggttgtgtttgggcacttgtcctcttcctgttccttgagatggtgaccccagaggaggacatgcgttgggcccgctgtccctggccagtggccatcagccaagtgcctagcccctattgcactgaaactcgggcccttcctgtcaccttggtctcctgcgttgagcttgggtgagcccatccgggtgccactggatgcctaggcagggaggggggtgccctgggttgggtcgatgatgagaactttatattgttctgaagagaggtgatgacttaaaaatcatgctcaataggattacgctgaggcccagcctaggtgagaattttggaaggggacactagaatcccgaggtccccagcagggctgctgtattttaggctggatacctcgaggccctgaagggcacctcatggaggggcccaatcctgtctgtgctcctctattaggcacaccagactttctgtgtgggcttggtgtccacgctcagcttccctggggtgggacacgttggcggctcctccgtgagccccattatcctctgtgtctttcagtgagctcttccccccagcagacccctgggattgacgagcataggtgagtggagactgctggtgtcatgggccatgagccaagctgcgtggggtccccaagggtcagccctcgggccacctgggtttcctcaggagctgatctgaatcccaactggggatgtgttctccaggagggcagcttccttgggaatcagacataaggaggaggccttctctgaagccccgcaggggtggcagttgtccaggcaggaaagggtttcctcagccccacgcagggcagtgctcagctcagacttggtgcttgggtcaggcctctaacatggccaggccacatgaggggggcaacaagggctccggggagccaagggcatctcacgggggctctccaaccctggagaagggtgggtgattcggtccatggggtcaggccatggagattcatggattgcagcaaacccaggaccctcaatgggactgaccctataagcagtgggccctcccagtggcacctctttgagccatttgtggggcggcgctgtttctctgaggttgggtcaagactagctctggccagtgcctgatggtggtgcaatccactcctgggactcgtgggctctgggccaaggctgcagcccatgtcccgctgggggtcaccccttcattgtgggcgagtggcagtaatggcctcctgagttgggaaggcccgcagtggaaggacctttcctggaaatttgcagtccaggctgcttctcagccattaggacaactccagcgggttggggggcaggggcgggtcttaggcccaaagaaaggagaagataccatatgtctcccggttggctgagtgtggccctgctgtgtgtgtgggaggtgttgtgtggggcatggattgggacacaccagagaaagcttgtggccctggagccccaggctgcgatttccagtgcaccttgaggaaaggagggtgggtgccctccatgcacagggcagactgtgcaactgccaggtaggcaacagcacgtggtgtccgggccagggtccttggtttgctgtgagctctttggtgtccgtggcccctacccaaggatccagataccacccggggtcatgcaggggagctagcatgggcaatggaggtgctcaaggggcctgcagtagggcacagcccaggtgtcttgcctgagcccaggaacccacctgccctgtccttccatggttcagtggctgggagagcaaagggttccgctgatctatgacacatcagtgtttcccatggatcccatcacatgggtccacggagagagagcatgtgtgagctggcacccccaaccccattccctgtatggaggcgtgagcccatggttggacacatgtcctcctcctgtccccccagatggtgactgtggaagaagacttgctttgggaccgctggccccaggccagtggttgtcatccaggtgcccagcccttggtgcacttgagctcaagcccttcctggtgccctggcctcctgccctaagctgtggtgagcccatccaggtcccactggatgcatgcatggggaggagggtgccctgggttggatcgatgatgagaaccttatattgtcctgaagagaggtgatgacttaaaaatcatgctcaataggattacgctgaggcccagccttggtgagaattttggaagaggatgctgagatcccaaggtctctggcagggccactgtattttgggctggagacctggaggccctgaagggcatcttaggggtgcccgaccccatctctgcgctcctccttgaggcagcccaggctcccttgcgggcttggtgtcagccctccagttccctggggttgaggcacattggaggctccttcctgagcccccattctcccctgtgtctttcagcgagctcttctgcccagggggacccctggccttaagtgggataggtaagtggatcctgctggggtcgtggaccatgagccaggtcgctttgggtcactgagagtcacccttcaggccacgagggattcctcagggagcccatctgaaacccaccagggacggatggtttctccaggaggacagcttccttggaagtcggtcccaagaaggatgccttccctgaagccgtgcagagatgatggacgtccaagcaggaagggcttccttcaactcaatgcagtgcacatcctagctgagactcagtgcacaagtcaggcctggaggacttcccaggccacatgagggggtccacagggtctccaggggccacgggtgttatgagggtgctctctgtccccgaggcttgcagaggggcagggtgtgggtgatcggacttatggagtcaggccgtgaagattcaaggattgggcccaacccatggcccagcatgggccgaacctgtagagcaatgggccatcccggtggtgcatccttgagccttgtgggggtggtgtgaccttagtggggttgggtcaagcctgagctctggccttcacctggtggtgctgcaggctggccctgggaatttgggctttgggccaagggtgcagtctgtgtcccgctaaaggtcacccctccccaaagtggagtggccagaaggatggcatcctgtggtagaagtcccactgtcaagggtcctgtcctggcaatttgttgcccaggctgcttctaagccatgggttcacctccaaagtggcggggtcttgagccgaaggaaaggggaagacatcatgtgttccctgattgactgagcatggcctggctctgcatttggaggtgtgcggtgcacgaatggggacccatcagagaaggcatgtggccctggggctccaggatttgatttctggtgtgagcttttacagggggtctgtagtggcacgtagcattcaggtcagcctacttggtttgctctgagcttgttggtggtcctggccctgcccagtggtcccattgtggcatagagtcatgtgagggagctgtggcaaggagggccaagggttccccacattcatgatcgttactgtttacatggatcccatctcttgagtccatggagggacagcatgtgtgagccagcaccccctgcccactttcctgcatggaggcgtgaggccgtatttctatacgtgtcccccacccctccagatggtgaccccagaggaagacgtgcattgggtccgctggccccaggccagtgtctctcagccatgtgctcaacacctggtgagctgaagctcaggcccttcctggcatcctggtctcctgcactgagctgtggtgagcacatctgggttcctctggatacgtgtgcagggagggggatgcactgggtcgggtcaatgatgagaaccttatattgttctgaagagaggtgatgacttaaaaatcatgctcaataggattacgctgaggcccagcctaggtgagaattttggaagaggatgctgggatcccaagttccccagcatggccagtatattttaggcaggagaccctgaggctctgaacggcatctccggggggcacaaccctggctctgggctcctctgggaggcagcccaggttccctgtgcaggcttgggctctggttccctgagcccccattctccctcgtgtgtttcagtgagctcgtcctcctaggtggggcccccaggcattgaccggcataggtgagtggtcctgctggggtcatgggtcatcagcaggttggagtcaccaagggtcagcctttgagacaggagggtttccacaggcagccgacctgaatccacaccatggagggatagattggtcctccaagagggctgttttttttcggaatcagacccaaggaggataccttccctgcagccctgcggggatgacggtggtccaggcagggaagggttccttcagtctcacgcaggtcagctcccagctgagtctcagtgcattggtctggcctccaggactgaccaggccacgtgaggggggcaacaggggcttcgggatgcagtggggtcacacaggatctctccatccccagagaaaggtgggcatagaacccatggattcgagctgcagagattcaagaatcgcacacgaattattgccctgaatgggacccaccctgttgagcaatgtcccatcccagggcacctctttgagcctgaagggggtggtgctgtttccctaggtttgggtcaaggctgagctctggccagtgcctggtggtgctgtagtcctgtcatggactcgttagctttacgccaaggggtcagcccacgtcctactggggatctccccttccctgtggctggaagtcaccccttccccattggcaagtgtcaggaagggtgacctcctgaggtggaagtcctgttgagggtcttgtccctggaatatgccacgcatgctgcttctgagccatggggtcacctccagggtagcgggtcttgggcccaaggaaaggagaagtcaccatgtgtcccccgattagccaagtgcggccctgctctgtgtttaggaggtgtgtggggcatggatggggacccaccagagaaagcatgtggcccagggaccccaggttgcaatttctaggacatgctgggatagggcacctgtgtgggtgtccacagtgcacagggataggctatgtgacttgcaggtctgcagcggcatctggcatccaggccagcctccttggtgggccgtgaactgaatggtggcgctggcctgtgcccagtatatctggtatgaccctggggtcgtgtgggggagccggcatgggcagtggaggtgcttatgggacctgcagtaggacacagtcggggcttcttgcccaagcccagtgacccgcttgccctgtccttccagggttcggtggctgagagagcttttgttgccctgtgtccgtgacgggccagtgttctgcatgcatcccatcacatggatccatggagggtgagcatccctgggctgacacaccccaccttctgcccccatggaggggtgaggttgtgttttcacacctgtcttactcctgtttccccagatgttgagcccagaggaagacttgcactgggcccaatggccccaggtcagcgtccatcagccaggtgtccagcccctggtgcactgaagatcgggcccttcctggtgccctggtctcctgcattgagctgtggtgagcacatccggatcctgctggatgcgtgtgcggggaagggggtgccctgggttgggtcaatgagaaccttatattgtcctgaagagaggtgataacttaaaaatcatgctcaataataggattacgctgaggcccagtctaggtgagaggtttggaagaggatgctgggattccgaggtccccaggagggcccctgtatttttggctggagacctggaggccctgaagggcatcttgtgggtgcccaaccctgtctctgcgctcctccttgaggcagcccaggctccctgtgcaggcttggtgtcagccctccagttccctgggtttgaggcacatgggaagctcctttctgagccccgttctcctcttgtgtctttcagtgagctcttccacatggaagacccctgtcattgactggcataggtgagtggctggcatcatgggccatgagccaggccgcgtgaggtcgccaagggtcagccttcgggaaagaagggtttcctcagggagccaacctgaatccccactgggaagatatgggttctccaggagggcgacttcctgggaaacaagaaccaaggaggtccccttccctgaagccctgcaggggtgacggtggtccaggcaggaaagggttccttcagttccacccagggcagctcccagctgaggctcggtgcttgcgtctggacttaaggactgccctggccatatgaggggtgccacagtggctctggggtgccatggggtcacacaggcactctctgtccctggagaaaggtgggtgattgggcccatggagttgagctgttgagatgcaagttttgcacctgacacatggccctgaatgggacccaccctgttgagcaatgggccatcccatgggcctcttcgagcctgaaggggggcggtgctgtttcactgggtttaggtcaaagctgacctctggccgccacctggtggtgctgcagtccagcccttggactcgtgggctttgggccaagggggcagcctgcatcccactgaaagtcaccccttccctgtggctggaagttatcccttcctcatgggcgagtgttgggaagggtggcctcctgaagtgggaaggcccgctattgagggtctgctcctggcaatttgctgcccatgctgcttctgagccatggagtcaccaccagtgtggtggggtcttggacccgaagaaaggagaagacactgtgccccccgattagctgagtgtggccaggctgtgtgtttgcgaggtgtgaagggcatggatggagactcaccagagaaagcatgtggccctggggccccaggttgtggtttccagtatgtgcttggatatggcatatgggtgggtgcctaccatgcacagggactggctatgtgactgccagctgtgcagcagcatcaggcatacgggccagcctccttggttgaccatgaactggttgctggccctggcctgtgcccagtagtcctggggtgaccctggtgtcatgtaggggagctggcatgtgtagtggaggtgctcgtgtggtctgcagtagggagcagccctggcttctagcctgagcccagtgacctgcctgtcctgtcctttcagggttcagtggcggagagagcatcaggtggcccacgtctgtgatgggccagtattccacatggatctcatcacatgggtccatggaaggcgagcatccctgagctggcacaccccaccttctgccagcatggaagggtgaggttgcatttggcacctgtcctcttcctgttcctcgagatggtgaccccagaggaggacttgcattgggcccactgtccccgggccagtggccatcagccgggtgcctagcccctgttgcactgaagctcaggcccttcctgttgccctggtctcctgcattgagcttgggtgagcccatccggttgccactggatgcctaagcagggaggggggttccctgggttgggtcaatgatgagaaccttacattgttctgaagagagatgatgacttaaaaatcatgctcaataggattacgctgaggcccagcctaggtgagaattttggaagaggacgctgggatccctaggtccctgacagggccactgtattttgggctggagacctggagtccttgaagggcatctggagggggcccaaacctgtctctacgttcctccatgaggcagtccaggctccctgtgcgagcttcgtgtcggtgctcagattccccttggtggtgcatgtgggtggctcatccctgagcccctgttctccccttgtgtctttcagtgaactcgtttgcccaggaggacccctggccttgagcagcataggtcagtggatcctactggggtcatgggccatggaccaggccacgtggggtcactgagggtcagctatcaggacaggagggattcctcagggagacaacctgaatccccactggtgagggattggttctccagaagggccgcctccttgggaatctgacccaaggaggacaccttccctgaagtgctacaggagtgacattggtccaggcaggaaagggttccattagtcccatgcaggtcagctcccagctgagacttggtgctagggtctggccttgaggactgcccaagccacatgaaggtggccccaggctgtgatttttggtgcgtgcttggagagggagtctgggcaccctccctgcacaggggcaggctgtgcgtctgccaggtctacagtggcgcctagcttcagagcaagcttccttggttggccttagctggttggtggccctggctcctacccaggggtcacaatgcagcccaggaagtgcagggaagccggcttggacagtggaggtgctccaggggcctgcggtagggcacagcctcggcatcttgcctgagcctagttactcgcctgtcctgtccttccagggtttggtggtggggagatacaagggttccccaggtccataactgtcctcgtttcacatggatcccatcacatgagtccacggatgtagagcatgtgtagccagcagcccctccccgctttcctgcatggaatcttaaggccctatttggacacctttccccgtccctccagatggtgagcacagaggaagaattgcgttaggccctttggccccggaccagtgtctgccagccacgtgctcagcctcccgtgcgctaaagctcaggtccttcctgtcatcctggtatcctgcactgaggtgtggtgagtccatccaggtccctctggatgtgtgagtggggatgggggtgtcctgggttgggtcgatgatgagaaccttatattgtcctgaagagaggtgatgacttaaaaatcatgctcaataggattacgctgaggcccaacttaggtgagaattttgaaagaggatgctgggaatcacaaggtccccggcaggaccactgtattttaggcgggagacctcgaggccctgaagggcatatcatggaggggtacccaacccagtctgtgctcctccattaggcacaccaggcttcctgtgtgggcttggtgtctgcactcagcttccccgggggtgggacacattggtggctccttcctgagtcgcattctcctctgtgtctttcagtgagctcttccccccagcaggccccctgggattgactggcaaaggtgagtggatactgctcgtgtcatgggctgtgagccaagctgcgtggggtccccaagggtcagccctcgggtcacctgggtttcctcaggagctgatctgaatcctgactggggatgtgttctccaggagggcagcttccttgggaatctgacacaaggaggaggccttctctggagccctgcaggggtggtggtggtccaggcaggaaagggtttcctcagctccacacaggacagtggagctgggcagtgctcagctcagacttggtgctcaggtcaggcctctaggatggccaggccacatgacgggggccacaagggctccagggcaccacagacatctcatgggggctctccaaccctggagaagggtgggcaatttggcccattgggtcgggtcatggagcttcaaggattgcaccaaacccatatccctcaatgggaccgaccctattaagcaatgggccatcccagtggcacctctttgagccatgtggtgggtggcgctgtttctctgaggttgggtcaagactagctccggccagtgcctgatggtggtgcagtccagtcctgggactcgtgggctttgggccaagggtgcagcccgtgtcctactggggatcaccccttccttatgagggagtggtgggaagggtatcctcctgaggtaggaaggcccgctgtggaaggaactttcctggaaatttgcagtccagactgcttctgagccatgaggtcatctccggggtggcggggtcttgggcccaaggaaaggagaagacaccatatgtctcccgattggttgagtatggctccactctgtgtgtgggaggtgttgtgtggggcatggattgggacccaccagagaaagctcgtggcactggaaccccaagctgcaatttccagtgcaccttgggaaggggactgggtgctcaccctccatgcacagggcaggctgtgcagctgccaagttggcagtggtgcgtggcatccgggccagcgtccttggttcgctgtgagctggttggtgtccttgacgcctgcccaggggtcccagtgctgcttggggtcatgaggggagccagcgtgggcaagggaggcctgcagtagggcacagcccgggggtcttgcctgagcccaggatcctgccggccctgtccttccatggttcggtggctgggagggcaaagggtcccccacgtctgagacacatcagtgtttcacatggatctcatcacatgggtccatagagagagagcaagcgtgagctgacaccccccacccccttccctgtatagaggtctgagcccctggttggacacatgtcttcctcctgtccccccagatggtgtctgtggaggaagacttgccattgggttgctggccccaggccagtggttgtcatccaggtgcccagccttggtgcactgaagctcaggcccttcctggtgctctggtctcctgcactgagctgtggtgagcacatccgggtcccactggatgggtgtgtgtggtggggggtgccctgggttgggtcgatgatgagaaccttatattgtctgaagagaggtgatgacttaaaaatcatgctcaataggattacgctgaggcccagcctaggtgagaattttggaagaggatgctgggaattacaagttccctgtgaagtccactgtattttgagctagagacctggaggctctgagggcatctggagggtgcccaaccctgtctctgcactcctccatgaggcagcccaggctcactctgtgggcttggtgtcggcgctcctgttacccaagggtggggtactttggcatctcctccctgagcccccattctcccctgtgtctttcagtgacctcttttgcccggcagaccccctggcattgaccagcataggtgagtggatcctgctggggtcatgggtcatgagccaggctgtgtggggttgccgagcatcagcctttggctgcaagggtttcctcaggaactgacccgaatgcccacctgggatgggttctccaggagggcagcttccttaggaatcggacccaaggaggataccttccatgaagccctgcaggggttgtggtggtccaggcagtaaagggtttcctcagccccatgcagggcagcacccagctgaaactcggtgcttaagtcaggcctctaggatggcccgtccacatgaggggaaccacaagggcactggggcgccaagggggtcttatgggggctctccgaccttggagaggtatgtgtgattcggcccatgaggtcaggttttggattttcaaggatctctccaaacccatggccctgaatgggaccgaccctattaagctatgggccatcccagtggtgcctctttgagccaagtgtggggtggcactgtttccatgaggttgggtcaagactagctctggtgaccccatgatggtgctgcagtctggccctgggactcgtgggctttgggccaagggtatagcccatgtcccaccaggggccacaccttccttgtgggcaagtggcggacagggtgtcctcctgaggtgagaaggcctgctgtggaaggacctgtccaggctgcttccaagctatggggtcacctacagggtggtggggtcaaggaaaggagaagacaccatgtgtctcccgattggctgagtgtggccccactctgtgtgtgggaggtgttgtgtgaggcatggatggggacatatcagagaacacacgaggccctgggtccccaggctgcaatttccggtgtggtgtggagcagggcctgggtgcttgccctccacacacaggggcaggctgtgctactgccagattggcagcagtacgtggcatccaggccagcctccttggttggccgtgagacggtaggtggccctggctgacacccaggggccagtacagccctggggtcatgtgaggcaactggagtgggtagtggaggtgctcaaggtgcctgcagtagggcatagccagggcgtcttgcctgagcccagtgacctacctgccctgtccttccagggttcagtggtgcagagggccaaagttcccctgtgtccatgacacatcagtgtttcacatggatcccatcacatgggtccatggtgggagagcaatcgtgagctagcatcccccacccccttcctgcatggaggcgtgaggttccatttggacacatgtccacctcctgtcccccagatagtgagactggaagaaaactttcattgggcccgctgtcccggggtgagtggtcatcagtcaggtgcccagcccttggtgtggtgaagctcaggctcttcctggcgccctggtctcctgcacggagctgcggtgagcacatccgggtcccgatggatgcatgcgtggggatggagggcgtgccctgagttgggtcaatgatgagaaccttatattgtcctgaagagaggtgatgacttaaaaatcatgctcaataggattacgctgaggcccagcttaggtgagaattctggaagaggatgctgagatccgaagtcccctggaagggccactgtattttgggctggagtccttgaggccctgaaggacaccttcggggtgcccaacccagtctctgcactcctctgtgtggcagccaaggctccttgtgcaggcttggtgttggcattctggttccctgggggtggagcacatcgacggctcctccctgagcccccgttcttctctgtgtctttcagtgagctcttctacccaggcgggcccctgcccttgagcggcataggtgagtggatcttgctggggtcacgggccaagagccaggccacggggggtcgctgagggtcacctttcaggccacgagggtttccttagggagctgacctgaatccccaccagagatggatggtttctccggaagggcagcttccttgttaattgatcccaagaaggacgccttccctgaaaccctgcaggggtaatggaggcccaggcagcagagagttccttcaacccaatacagtgcagcagcttgttgccttgatgctccccctccctggagaaaggtgggcatagggcccgtggagttgagttgcagagatttaaggatcgcacaggacttattgacctaaatgggactgaccctgttgagcaacgtgcacttggtgcatgggtcaggtgtggagcactgcccaggccacatgaggggtccactgggtctctgggggccacgggtgttatgcaggagctctccgtccccaaggcttgcaggggggtaggatgtcggtgatcgagcttatgcagtcaggccgtgaagattcaaggattgggcccaacccatggccctgatgggaccgaccctgttgagcaatgggctatcccactggtgcctccttgagcctggtgggggcagtgcggcctcagtgggcttggatcaaggctgagctctggccagcacctggtgtttggccctgggaatcgtgggctttgggccaagggttcagcctgtgtcccactggagttcatccctaccggaagtggagtggatggaagggtggcatcctgtggtggaagacccaccgttaagggtcctgtcctggcaatttgatgcccaggctacttctgagccatggagtcacctccagggtagcagggtcttgagccaaaggaaagttgaggacatcatgtgtcctctgattggccgagcgtggcccagctctgtgtttaggaggtgtgcggtgcatgaatggggacccaccagagaaggcatgtggccctggggccccaggatgtgatttctggtgtgtgcttataaagggtgcctggatgggttcatttaatgcccaggggcaggccatgtgactgccaggtctgcagtggtacgtggcatccaggccagcctccttgatttgctgtgagctatttggtgcccatggccctgcccagtggtcctgatgcagcccagattcgagcaggggatttggcgtgggcagtggaggtgctccagggtcctgcactagggtgcagcctgggcgttttgctcgaaccctgtgaccctcctgccccgtccttccagggttcagtggccaagggttcctcgcgtaaatgaccatcactgttttacatggatctcatctcatgagtccatggagggagagcatgtgtgagccagcaccccctgcccactttcctgcatggaggcatgaggccttgtttggacacctgtcccccacccttccagatggtgaccccagaggaagacttgcgttgggcccactggctctgggctcagcccctggtgagctgaagctcaggcccttcctggcaccctggtctgctgcactgagctgcggtgagcctatctgggtcccactggatgcatgggttgcggggcagtggagggtgatgccctgggttgggtcgatgatgagaaccttatattgtcctgaagagaggtgatgacttaaaaatcatgctcaataggattacgctgaggcccagcctaggtgagaattttggaagaaggtgctgggatccggagttccctggaatgaccaatgtattttgggctggagaccttgaggccctgaacagcagcatctcgtgggggcccaaccccttctccgtgctcctctgtgaggcagcccaggctccctgtgtgggcttggtgttagtgctccggttctgtgaacccccattctccccttgtgtctttcagtgagctcttccacccaggtgcaaccccctggcattgaccagcataggtgagtggtcccgctggggtcatgggtcatcagtcatgcagtgtggggtcaccaagagtcagcctttgagacaggagggtttccacaggcagctgacctgaatccacaccatggaagggtaggttggtcctccaagagggctgtttttttgggaatcggacccaaggatgatatctttcctgcagccctgcagtgatgacggtggtccaggcaggaaaagtttccttcaatctcatgcagggcagctcccagctgagtctcagtgcactggtctggcctcgaggactgaccaggccacgtgaggggggccacaggggctttgggatgccatggggtcacacaagagctccccatccctggagaaaggtgggcatagagcccatggagttgagctgcagatatttaaggatcacacaggatttatagccctgaatgggaccgaccctgttgagcaatgtgccatccatcctatggtacctctttgggcctggatggggtgttgctgtttccctaggttttggtcaaggctgagctctggccagtgcctggtggtgctacagtccagccacggacttgttagctttaggccaagggatcagtccacgtcctgctggggatctccccttccctgtggctggaagtcaccccttccccattggcaagtgtgaggaagggtggcctcctgaggtggaaggcctgctgttgagggtcttgtccctggaatatgccacccacactgcttctgagccatagggtcacctccaggatagtgggtattgggccaaaggaaagaagtcaccatgtgtcccctgattagccaagtgtggccctgctctgtgtttaggaggtgtgtggggcatggatggggacccaccagagaaagcatgtggccctgggactccaggttgtgatttccagttcatgctgggatagggcacctggatgggtgcccacaatgcaccggggcaggctatgtgactgccagctttgcagcggcatctggcatccgggccagcctccttggttggccatgaactggttggtggccctggcctgtgcccagtagctctgtcgtaatcctggggtcatgcgagggagccggcatgggcagtggaggtgctcgtgggacctgcggtaggacacagccaggtcttcttgcccgagcccagtgacccacctgccctgtccttccagggttcagtggttgagagtacagggtgacttgtgtctgtgacaagccagtgttctgcatggatcccatcacgtggatccatggacggcaagcatccctgagccgccacaccccaccttctgcctccatggaggggtgaggttgtgtgtggacgcctgtcctactcctgtttccccaggtattgagcctggaggaagacttgaattggtcccaatggtcccaggccagcatccatcagctaggtgctgagcccctggtgcactgaagattgggcacttcctggcaccctggtgtgctgcaccgagctgtgatgagcacatccgggtcctgctggatgcatgcgccgggaaggacgtgccctgagttgggtcgatgatgagaaccttatattatcctgaagagaggtgatgacttaaaaatcatgctcaataggattacgctgaggcccagtctaggtgagagttttggaagaggatgctgggatcctgaggtcccctggtagagccaattgtattttgggctggagacctggaagccctgaagggcatctgggaggcccaaccctgtctctgtgctcctccatgaggcagccctggctccccatgtaggcttggtgatggccttcctgttccctgggggtggggcacatgggtagctcctccctgacccccattctctcctgtgtctttcagtgagctcttccccacaggtgggccccctggcattgactagcatcggtgagtggatcctgctggggtcgtgggccgtgcaccaggctgcatggggtcaccaagtattagccttcaggacaggagggtttcctcagggagtcgaccttaatcctcacctgtggagagatgggtttgtcctctaggagggcagcttcctgggaaatcagacccaagacgatgccttccctgaagccctgcaggggtgacggtggtccagtctggaaagggttccttcagtctcatgcagggcagctcccagctgacacttggtgtgagagtctgtccttgaggactgcccaggacaaatgagtgggacaacagaggctcccggataccacagggatcactcaggggctctccgtccctggaaatgggtgggcgatcgggcccatggggtggggctgcggagattcaaggatcgtgccctgctcatggccctgaatgcaaatgaccctgttgagcaatgggtcacaccagtagctcctttttgagcctggtgggtggcggctcagcttcaactggttgggtcaaggctgagccatgactggtgctttgtggtgccgcaggccaaccctgggactcatgggctttgggtcaagggtgcagcccgcctgctgctgggggtcaccccttcttcgaggtcagtggcgggaagggtcacgtcccgaggttggaaagccccctcatgagggacctgtcctgggaatttgttgcccaggctgcttctgagccatgtggtcacttccgggtggcggggtcttgggcccaaggaaaggagagggcaccatgtggctcctgattggctcagtgtggcccagctctgtgtttgacaggggtctggggtgtggatgaggacccaccagacaaagcacgtggccctgggcccaggctgtgatttctggtgcgtgcttggagaaggatcctgggcaggcattctctccaaacaggggcaggttgtgggactgccagattggcagcagtgcctggcatccaggccagcatccttggttggctgtgagctggttggtgaccttggaccctgcccagggtttccgttgtggtccagagtcatgcagtggggccagtgtgagcagtggaggtgctccaggggcctgctgtatggcacagccagggcatcttacccaagccctcctgcactggtctcctgcactgagctgtggtgagcccatctgggttcctgtgatgcctgtgcggggagggggttgccctgggttgggtcgatgatgagaaacttatattgtctgaagagaggtgatgacttaaaaatcatgctcaataggattacgctgaggcccagcctaggtgagaattttggaagaggatgctgggaattatgagttccctggcagaaccactgtattttgggctggagacctggaggctctgagggcatctggagggtgcccaaccctgtctctgcgctcctccgtgaggcagcccaggctcactatgtgggcttggtgttggcactcctgttacccgggggtggggcattttggcatctcctttctgagcccccaatctcccctgtgtctttcagtgagctcttctgcccagcagcctccctggcagtgaccagcataggtgagtggatcctgctggggtaatggcccatgagccaggctgtgtggggtcaccaagcatcagccttcagccataagagtttcctcaggagctgacccgaatgcccacctgggatgggttctccagaagagtggcttccttggaaatcatacccaaggaagataccttccctgaagccctgcaggggttgcagtggtccaggcagtaaagggttttctcaacctcatgcagggcagtgccccactaagactcagtgctctggtcaggcctttaggatggccaggccacatgagaggggccacaagggctctggggcaccaaggggttcttgcaggggctcttcaaccttggagaggtgtgtgtaattcagcccatgaggtcaggctgtggattttcaaggattgcaccaaacccatggccctgaatgggacaaaccctaataagttatgggccatcccagtggtgcctctttgagccaagtgtggggtggcactgtttcctaagggtgagtcaagactagctctggctggcacctgatggtggtgcaatcctgccctgggattggtgggctttgggacatgggtacagcccatgtcccattggggtcaccccttcattgtggacaggtggcgggaagcatgtcctcctgaggtgggaaggcctgctgtggaagaccctgtctcagaaatttgctgtcttggctgcttctgagctatggcgtcacctctgtggtggcgggagtctcgggtgaatggatcctgctggggtcatgggccatgagccaggccggggtggggtccctgagcgtcacctttcgggtcatgagggtttcctaagggagccgacctgaatccccaccagggatgaatggtttctctgggaagcaggtttccttggaaatcagtcccaagaaggacaccttccctgaaaccttgcaggggtaacagaggtccaggcaagagagggttctttcaacccaacgcagtgcagatcctagctgagacttggtgcacaggtgagtcctggaggactgcccaggccacatgagggcatccacagggtctccgtggccaggagtcttatacgggagccctctgtccccgaggcttgcagaggggttgggtgtgggtgatctggcttacggagtcaggccgtgaacattcaagggtcgggaaccacccatggccctgaatgggaccgaccctgttgagcaatggccatcctggtggtggcaccttgagcctggtgggggtggcgctgcctcagtggggttgggtcaaggctgagctctgcctgtcaccttgtggttggccctgggaatcatgggctttgggccaagggtgcagcctgcgtcccgcttgaggtcactcctacctgaagtggagtggccggaagggtggcatcctgtggtgggagacccacggtcaaggatcctgtgctggcaatttgctgcgcagcctggttctgagtcatggggtcacctccagggtgacagggtctttgtcaaagggaaggagaggacattatgtggcccctgattggccaagcatggcccagctctgtgtttgggaggtatgcggtgcctgaatggggacccaccagagaaggcacatggccctggggccccaggatggtatttctggtgtgagcttataaagggtgcatggatgggtgcattccatgcccagtggcgggttatgtgactgccaggtctgcagtggcacatggggtccgggccagcctccttggtttgccatgagctggttggtggcccaggccctgcctagtggtctcattgcagcccagagtcatgtgggggagctggcgtgggcagtcgaggtgctccagggtcctacagtagggtgcagcctgggcgtcttgctggaatcccatgacccacctgccctatccttccagggttgagtggcagggagggccaagggttcctcgtgtgcatgactgtcactgttttacatggatctcatctcatgagtccatggtgggagagcatgtgtgagccagcacaccctacccactttgccctatggaggcacaaggccctgtttggacacctgtcccccacccctccagatgctgaccctggaggaagaattgcactgggcccactggccccgggaaaatgtccctcagccaggtgcttagcccctggtaatctgaagctcaggcccttcctgatgccctggtctcctgcactgagctgtggtgagcacatctgggtcccaatggatgcatgcatgcgttgtggggtggtggtgtcctgggttgggtcgatgatgagaaccttatatgttctgaagagaggtgatgacttaaaaatcatgctcaataggattacgctgaggcccagcctaggtgagaattttggaagaggatgctgggatttctaggtccctgtcatgggcactgtattttggactggagacctccgggccctgaacagcatctcgggggggactctaccctgtctccacattacatgtgaggcagcccaggctccctttgtgggcttggtgtctgcactctggttccctgtggtagggcagcttgctgggtccttcctgagcccctgttctccctttgtgtcttctgtctttcagtgagctcttcagcccaggtgggctccctgacactgatgcgcataggtgagtggattctgctggcatcatgggccatgagccaagctgcgtagggtcaccaaaggtcactctttaggccacgtgggtttcctcagggagccgacctgaatccccaccaggttgggacagtttctccaggaggctggcttccttgggaatcagacccaagacaatgccttccctgaagccttacaggggtaacagttgtccagacaggaaagggtcccctcagtcccattgaaggcagctcccagctgagactcagtgtgcgagtctggcctcaaggatggcccaggccacatgaaggaggccacaggggctctggggtgccacaggggtcacacgagagctctctttccctggagtggggtgctcgaatgagcccatggggtcaggctgcagagattcaaggatcgcatcccaaccgtggccctaaatgcgaccgaccatgttgagtaatgggccatctcagtggggcctctttgagcctggtggggggcggggctgtttccctgggtttgggtcaaggctgagctctggccagcgcctggtgatgctgcaggccagcccaggttcttgtgggcgttggtccattcggcagccctgtcctcctggaggtcaccccttgcctattggtgattggctggatcctgaggtggaaagacctgctgttgatggtcctgtcccaggaatttaccacccaggctgcttctgagccatggggtcacctccagggtggcggagtcttggggctaagaaaaaagaggacactatgtagcccacggttggccaagggtggcctgactctgtgtttgggacatgtgcggggcatggatagggacccgccagagaaagcacgtggcccggggactccaggcttcgatttcaggtgtggcttgcaaatagcacctaggcaggtgcccaccacgccctggggcaggctatgcaacttccatctccacagtggcgcatggcttctgggccattctccttggttggccatgagctgattggttcccctggcctgtgccctgtggtcccggagtggctctgggatcgtgtggggcagccagcatggacagtggagatgctatcaaggccttcagtagggtgcagcccaggtttcttgcctgaacccagtgacccacctaccctgtgttttcagggtttgctgacagggaaggccaaacgtgccccacgtccatgctaggtcagtgttcctcatggaccccatcacatgggtatcccttaccccttccccacatggaagtatgaggctctgtttggacacatgtcctcttcctgtccccccagatggtgagcctggaggaagacttgcattgggcccaatggacccaggccagtggccatcagccaggtgcccaccctggtgtgctgaagcgcgggacctacctgttgtcctggtttcctacactgagctgaggtgagcacatctgggtccctctggatgcatgcatggggcggggggtgccctggtttgggtcaatgatgagaaccttatattatcctgaagagaggtgatgacttaaaaatcatgctcaataggattacgctgaggcccagcctaggtgagaatttggaagaggatgctgggatcccaaagtcccagtaggggactttatttatttattttgggctggagccctggaggccctgaagggcatctggggggcccagccctgtctctgtgctcctccgtgaggcagcccagcctccctgtgtgggcttgctgttggtggtccagttccttggggcggggcacgtggacagctcctccttgagcccccctgctccacttgtgtctttcagtgagctcttcaacccaggcggggcaccctggcattcaccagcataggtgagtggatcctgctgccatcgtgggccatgggccaggctgggtagagtcactgagggtcagccttcgggacaggagagtttcctcagggagcgaacctgaatccccaccagggagggataggttggtcctccagaagggtggcttcctgagaaatcggacccaagggggacgccttccctggagccctgcagtgatgacggtggtccaggcaggagagggttccttcagtctcacacatagtagctcccagctgagtctaggtgttcgagtctggccttgaggactgcccaggccacctgaggggccaacagggactctgggacaccatgggggtcacataggagctctccattcatggagaaagatggatgatagggcccatggagtcgagctgtggagatttaaggattgcgcccaatgtatggccctgaatgggacagaccctgttgagtaatgagccattctatgggcctcatcgagccttgagcggggcggtgctgtttccctatgtttgagtcaaggctggactctggccggtgcctggtggtgctgaggtctggccatggactcgttggctttgggccaaggggtcagcctgctccccctggaagtccccccttccccgtggctggaagtcatcccttcccaaggggcaagtgtcgggaatggttgcctcctgaggttgcaaggcctgctatctagggtcttgtctttggaatatgctgcccatgctgcttctgagtcatggggtcacctccagggtagcggatcttgggcccagggacagaagatgccgtgtgtcccctgattagctgattgtagccctgctctgtgttcaggaggtgtgtggggcatggatgcagacccaccagagaaaactgtggcccttagaccccaggttgcaatttccattatgtgctgggatagggcatctgggtgggcacccactatgcacagagataggctatgtgactgccagggctgtagcggcatctgacatctaggccagcttccttggtttcctgcgaatgagttggtggccctggcctgtgcctagtagttctggggtgaccccgggtcgtgtgggggagccagcaggggcccagtgaccagcctgccctgtccttccagagttctgtggctaagagagcactgggtaccctgtgtccgtgatgggccagtgttccgcatgcaaacgatcacatgggtccatggagggcaagcatacttgaactgccacaccccaccttctgctcacatacaggagtgaggttgtgtttggacagctgtcctactcctgttcccctagactgtgaaatgggaggaagaattgtgttgggcccaatggccctgggccagtatccgtcagcctggtgtccagcccctggtgtgctgaagctcatgcccttcctggtgccctagtttcctgcactgagcttggtgagcccatttgggtactgctggatgcatgggtggggagggaggtgccctgggttgggtcgatgatgagaaccttatattgtcctgaagagaggtgatgacttaaaaatcattctcaaaaggattatgctgaggcccaccctaggtgacaattttggaagaggacactggaaatcaatgaggtccctggcagggccactataatttggggtggagacctggaagccctgcagggcacctcgtgggggcccaaccctgtctcttcactcccctgtgaggcagcccaagctccctctgtaggcttggtgtcggcactctgctttcctggaggcggggcattttggctgctccttcctgagcccctgttctcccctgtgtctttcagtgagctcttttgcccagaagactccctggcattgatcggcataggtgagtgtctcctgcttgggtcatgggccatgagccagaccatagggttgccgagggtcagcatttgagccatgagggtttcctcaggaggcgacctgaatccccacctgggatgggttctccaggagggcagcttccttgtgaatctgagccaagtaagatgccttctctgaagccctgcaggggtgccagttgtgcaggcaagaaagggttccctcagccccaggcagggcagcgcccagcagagactcggtggttgggttaggcctctaggatgaccaggccacatgaggggggccacaagggctctggggcacaacaggggcttcgcagggtctctgcgaccccaaagagtggtgggcgattcggcccatgggatcgggccccagattcaaagatcacaccacacccatggccctgaatggaaccgaccctgttaagcattggggcatcccaggggtgccactttgaacctggtgtggggtgccgctgtttgcctgaggttgggtcgagactagctccggccagcacctgatggtggtgcagtccggccctgagattagtgggctgtgggcccagggtgcagcctgtgtcccgctgggggtcacctcttccttgtgggcgagtggtggaagggcatcctcctgaagtgggaaggcccgctgtggaaggaactgtcctggaaatttgccatccaggctgcttctgagccatggggtcgcctccagagtggcagggtcttgggcccaaggaaaggagaggacactgtgtttccctcaattagctgagtgtggccctgctctctgtgtgggaggtgttgtgtggggcatggatagggacccaccagagacaacacatggccctcgggccccaggctgcaatttctcagtgcatgcttggagacggtcctgggcctcctccatgcccagggtcaggctgtgcaactgtcaggttagcggcggcatgtggtgtctgggcctgtctacttcgttgtccgtgagctgctggtggccctagccctttcccaggggttcaggtgcagccctggggttgtgtgggacagccagtgtgggcagtggagctgctctggaggcctgctttagggtgcagcctgggtgtcttgcccgagtgtagtgacccgcctgccgtgtcctcacggggttccctagcaggaagggccaagggtcccctgtgtctgtgacacgtgagtgtttcccatgggtcccatcaaatgggtccacggagggagagcatgagtgaactggtaccccccacccccaccctcttccccacctggaggcatgagcccctggttggacatatgtcctcctcctgtacccccagatggcagcgctggaggaggacttgtactggggccgctggccccacatcagtgtccgtcatcccggcgtccagcccctggtgtgctgaagctcaggcccttccttgtgccctagtctcctgcactgagcttggtgagcccattcggatactgctggatgcatgggtcgggagggaggtgccctgggttgggtcgatgatgagaaccttatattgtcctgaagagaggtgatgacttaaaaatcattctcaaaaggattatgctgaggcccggcctaggttagaattttggaagaggatgctgggatcctgaggtccccaggagagcccctttatttttggctggagacctggaggccctgaagggtatctggggggcccagccctgtccctatactcctctgtgaggcagcccaggctctctgtgtgggcttggtgttggcactctggttttctgggggcggttcaggttgctggttccttctgaaccattgttctccccttgattctttcagtgagctcttctgctcaggcgggtcccctggcattgaccagcataggtaagtggatcctgctgggttcatgggccatgagccagaccacatggagtgactgagggtcagccttcaggacaggaagatttcctcggggagccaacctgaatccccaccgtggagggatgtgttagtcctccaggagggtggcttcctagggaatctgaccccaggaggacacctttgctgaagccctgcaggggtgatggtggtccaggctggaaagttttccttcagtctcatgtggggcagctccctgctgacattccgtgcctgcgtctgaccttgaggactgcccgggccacatgagtggggcaacaagggctccagggtgccacggggattatgagtggggctctccatccccggagagaggtgggcaatcaggcccatgtggtcaggcttgtagggttcggtggtggggagagccaaggtttccctgggtccattaccgtcactgtttcacctggatcccatcacatgggtccatggagggagagcatgtgtgaacaggcaccccttgctccctttcccacatgagcccctggttggacatatgtcctcctcctgtccccccagatggtggccctggaggaggacttgtattggggccactggccccacgtcagtgttcgtcagcctggcatccagcccctggtgtgctgaagctcaggcccttcctgttgccctagtctcctgcactgagcttggtgagtccattcggggactgctggatgcatgggcgggtagggaggtgccctgggttgggtcgatgatgagaaccttatattgtcctgaagagaggtgatgacttaaaaatcattctcaaaaggattatgctgaggcccggcctaggttagaattttggaagaggattctcggatcctgagatccccagccaggccactgaatttttggctggagtccttgaggccctgaagggtgtctgagggctgctgaaacctgtctctgtgcttgtccgtgaggcaacccacattcgctgtgtggacttggtgttggccttcccgttctccggggatgggacatactgtcagcttgtccctgagtacccgttctcccctgtgtctttcagtgagctcttctgcccaggtggtccccctggtcttgatgggcataggtgagtacatcctgctggtgtcctggtccatgagccagggtgcgtacggttgccggaggtcacctttaggccatgtgggtttcctcagggagctgacctgaatccccactgggagggatggtttctccaggaggatgtcttccatagaaactggttccaagaaggatgccttccctgaagctgtgcaggggtgacgatggtccaggcaggaaagggtccattcaacccaatgcagtacagcttctagctgagactcggtgcacgggtgagggcttgaggactcccaggcaacatgaggggttccacaggatctccggaggccacaggtgttaagcaggaactctccatccttgaggcttgctgggggtggcgggatggcagcagggtgtgggtgatcgagtttatggattcaggccaagattcaagggtcaggccccacccattgccctgatgggaccaaccctgttgtgcaatgggctgtcccactggtgcctccttgagcctggtgtgggcagcgtggcttcaatggggttgggtcaaggctgagctctggcccgcacctggtggttggccctgggaattgtggactttgggccaagggtgcagcccgcctgcctctggaggtcatcctacccagaggtggagtggccggaagggtggcaggcatcctgtggtgaaaggcccactgttgagggtcctgtcccaccaatttgctgttcaggctgcttctaagccatgggttcacctccagagaggcgggatcttgagcccagggaaaggagagggcatcatgtgtcccctgattggctgagaatggggagagtgtttgggtggtatgtggtgcatgaatggggacccaccagagaaggcgcgtggccctgggccccaggatgcaatttccggcgtgcttatagagggcgtctgagtggacactctccatgcccaggcgcaggctatgtgactgccaggtctgcagcagtttgtggcatctgggctagcctccttgattgcttatgagctggttgatagccctggcctgtgccgaggggtcctggtgcggccctggggttgttcaggggaagccggcatgggcagtggaggtgctcttggggcctgcagtagggcacagcccaggtgttcttgcttgagcgcagtgaaccacctgccctttccttccagggttcggtagcagggagggccaagggtcccccacgtccatgacaggtcagcgttcctcctggatcccatcacatgggtacatgcagggagagcatgtgtgagccggcactccccactctcttccccgcattgcagggtgaggccctgtttggacccatcttccagctatctcaccagatggtgagcccagaggaagaccccgtggctctgggccagtgtgcgtcagccaggtccccagcccccagtgtgctgaagctcaggcccttcccaacgccctggtctcctgcactgaggtgtggtgagcacaaccaggtcccactggatgcatgcacagggagggatgtgccctaggttgggtcgatgatgagaaccttatattgtcctgaagagaggtgatgacttaaaaatcatgctcaataggattatgctgaggcccagtctaggttaaaattctggaagaggatgctgggatcccaagttcacaggcagggccactgtattttggactagagaactcgaggccctaaagggcatcttgagggggtccaacctgtctctgtgctcctccatgaggcagccctggctccctgtgtggccttggtgttggtgctctggttcccaggcgtggcatgtgggcacctccttccagagcccccattctcccctgtctctttcagtgagctcttccgcccatttgggccctctgacattgaccggcataggtgagtggatcctctttgggtcatgggtcatgagcgaggcaaagtggggtcaccatgcatctgccttcgggccatgagagtttcctaaaagtgtggacctgaattcccaccggggatgagttatccagaagggccacttccttgggaatcggacccaagaaggacgcctgtcctgaagcccagcaggggtggtggtggtccaggcaggaaagggttcattcagcaccaagcaggcagctcccatctgagacttggtgcatcggtcaggccttgaggactgcccaggacacatgaggtggccacaggggctccggggcactacagggggtctgcagagaggggtaggcgattgggtccgtgggggtcatgccgcggagtttcaaggacacccatggccctgaatgggactgaccctgttgagtaatgggccatcccaatggcacctccttgagtctggcggtgggtggtgctgtttccctggggctaggtcaaggctgagctctggctagtgcctgtggtgctgcaggctggccctagaactcatgggctttgggccatggggacagcttgtgtcatgcttggggtcaccccttcccggaggttgaatggcgggagtggtggcttcctaaggtgggaagtcctgctattgagcaacctgtcctgggaatttgccacccaggctgcttctgagacatgaggtcacctccagagtggcagcatcttgggtccaaggaaagaggagcataacatgtgtccccagattggttgagtgtggcctagctctgtgtttgggaggtgtgcagggtgtggatggggatgtatcaaagaaagtacatagccctggagccccaggctgtgatttccagtgtgtgcttggagaggggcaggagcaggctctcgactgccaggtctgcagcagcgcgtggcatccgggcaagccttctggttggccatgtgctggttggtggccctggcctgtgcccagtggtctcagggtagacctggcattgtgcagggcagccagcagggcagtggaggtgctctcaggacctgcagtagggcgcagcctggactttttgtgtgagaccagtgacccacctgcactgtccttccagggttgggtggctgggagggccaagggtggtccatgtttgtctccgtgacacatcagtgctctgcatggatcctatcacatggatatcccctacccaccttccccacatggaagcatgaggccttacttggacatgtgtcctcctgtcctagatggtgagctcggaggaagacttgcattgggcccaatggagctgggccagtttctgtcagccaggtccccagctcctgatgcactgaagctcaggcccttcctggagccctggtctcctgccctgagctgtggtgagcccatctgggtcccactggatgcatgcatgggagggggttgccctcggttgggtcgatgatgagaaccttatattttctgaagagaggtgatgacttaaaaatcatgctcaataggattacgctgaggcccaacctaggggagaattttggaagaggacgctgggatcctgaggtccgtggcagggccaccgtattttgggctggagacctcaaggccctgaagggcatcttggcagcccccagccctgtctctgcactcctccgtgaggcagcccaggctccctgtgtgggcttggtgtcagagtcccattccccaggggcggggcaggttggcggctcctccctgagtcccctttctcccttgtgtctttgagtgacttcttctgcccaggtgggccccctggcgttgaccagcataggtgagtggaacctgctggtgtcatgggccatgagccaggccatgtggggactccaggtcagccttcaggacaggagagtttcctcagggagcaggggaatccccactggggagggatgggttctcccagagggccactttcttttgaatcggacccatggaggacatcttctctgaagacctgcagaagtgatgatgtttcaagcagcaaagggttttttcagcccctgcagggcaggcagctcccagatgagattctgtgcatgggtcaggcctcaagaactgcccaggccacatgcggggtgccacacaggctgtgaggcaccacaggggtcatgcaggagctctcggtcttcaggcttgttgtgggggtggtgacagagtgatcaggcccacagggtcaggctgcagtgtttcaaggatcgcgcccacctgtggccctgaatgggaccgatgctgttgagcaatgagccatcccagtggctccacattgagcctggtgggggcgccactgtttcagtggggatgggtgaagcttgagctctggccagcacctgatggtgttgcaggctggcccagggacttgtgggctttgggccaggtcggcagcctgagttctgctgggggtcacatctttcctgagtttcagtgtcaggatgcatggcctccttaggtgggaaggcctgctgtggagggtcctgtcctgggaatttgctgcccaggctgcttctgagccatggcgtcacctccaggtggtggggtcttgggcccaaggagcagagaagacaccatgtggcccctgattggtcgagtatggcctggctctgagtttgggaggtgtgcagggcatggatggggacccaccagagaaagcacgggccaatgaagccccaggctgcgatttctgatgcgcacttggagagggcgcctggttgggcgcccaccatgcccaagggtaggctatgcaactaccaggtctgcggcagtgcctggcatcaggaccagcctcctttgttggctgtgagctggttggtggccctagcccgtgtccagtgatctctgtgcagccctggggtcatgtggagcagccagtgtaggcaggggaggttatcttgaggtgtgcagtaggcacatcccaggcatcttgcccgagcccagtgacctccctgccctgtccttccagggttcggtggcggggaggcccaagggtaccctgtgtccatgacaggtcagtatttcatgtgaatcccatcacatgggccctcctcctgtccccccagatggtgagcctggaggaagacttgcactgggccttctgtgcgccggccagaggccatcaaccaggtgcccaggtccttttgtactgaagcttgggcccttcctggcaccctggtctccttcatggagctggtgagcccatccgggttcttctggatgtatgcatggggagcggggtgcactgggttgggtcaatgatgagaaccttatattgtcctgaagagaggtgatgacttaaaaatcatgctcaataggattacgctgagtcccagcctaggtgacaattttggaagtggacactgagaatcacaaggaccctggcagggccactgtattttgggctggagacctggaggccctcaagggcctctcacagggacccaaccctgtctctgcactcctccgtgaagcacagcaggctccctgtgcggacttggtgttggcactgtttcccaggggcagggcacattggtggcttttccctgagtccccattcttgccttgtgtctttcagtgagctcttcagctcagaagggccccttcaccttgattagcctaggtgagtgcatcctgctggtgtcatgggccatgagtcaggccgcgtggggtcaccaagggtcagtctttaggacaggagggtttcctcagggagccaacctgtatttccaccggggagggatggtttctacaggagggcggcttccttgggaactggacccaagatgttgccttcctgaagccctgcagggatgacagtggtccaggcagcaaagacttccttcagccccgtgcaggagagctcccagctgagactcagtgcatgtgtcaggcctcgaggattgccgaggccacatgatgggggccacagggcctccggggcaccacgggggtcatgcaagagttctctttccctggagaggggtgcttgaatgagcctatgggattgggccgtggagattcaaggattgtacccaactatgtcccaaaatgggactgaccctgttgagctatggaccatcccatggtgcctctttgagcttggtggggggcagtgctgtttccctgggtttgggtcaaggctgagctctggccagtgcctggtgaggctgtgggccggacctgggactcgtgagctttaggccaagtcgacagcttgtgtcctgctggaggtcaccccttccccatgggtgagtggctggaagagtggaatgtgcggtgggaaggcccgctgttgatggtcctatcctgagaatttgctgcccagactctctgtgccatggggtcatgtccagggtggcagggtcttgggcctagggaaaggaaaggacaccatgtggcccaggattggccaagggtggcccggatctgtgtttgggacatgtgtggggcatggatggggacccaccagagaaagcacatggccctggtactccaggctgtgatttcaggtgtggcttggagagagtgcctgggcaggtgcccaccatgcccagcggcaggctatgcaacttccatgtccacggtggcacatggcttctgggccaggctcctcggttggccatgagcatgtcggtgaccctgtcccatgctcagtggtcctggggcagccctgggatcgtgtgaaggagaagtcagagggggcactggatgtgccctcaaggtctgcaatagcatgaagaccaggggtcttgcccaagcccagtgatccacctgccctgttttttcagggtttggtgatggggagggccgagagtgccctgtatccgtgacaggtcagtgttccacatggatcccatcacatgggtatcccttaccccattccccacctggaggtatgaggccctgtttggacacatgtcctcctcctgtccatccagatggtgagcctgaaggaagacttgcatcaggaccaatggaccctggcaagtgtccgtcagccaggtgctcagcccctggtgcactgaagctcaggcccttcctggccccttgatctcctgcactgagctgtggtgagcacatccgggtcccgctggatgtatgtgtgggcagggggggtgccctgggttgggtcaatgatgagaaccctatattgtgttgaagagaggtgatgacttaaaattaccatgctcaatgattacgctgaggcccaacctaggtgagaaatttggaggaggatgctgggatcccgagatttccggcagggccactgtattttgggctggagccctggaggccctgaaaggtatctggaggaggcccaactctgtctctgcactcctctgtgaggcagcccaggctccctgtgcgggcttggtgttggcctttctgttccccagtgaagtggcacgtgggtggctcctccctgagccccagttctccccttgtgtctttcagtgagctcttctgccaagggggggcctcctggcattgaccaacataggtgagtggatcctgctggcatcatgggcatgggttcactgagggtcagacttcaggccatgagggtttcctcagggagctgaccccaattcccatcagggagggatggtttctccaggagggcggcttccttgggaatcttacctgaggaggatgccttccctgaagatctgcaggaatgacaatggtccagatagcaaagggttccttcagccccatgcaggacatcgcccagttgagacttggtgtgcaggtcaggccttgaggactgcccaggccacatgaggcgggccagaagggctccagggtgccacgggtttcacttgggagctctcggtccccgggcatgttcctggggggggtggtgatggggtcgggccatggaggttcaaggatctcatcccacctgtgaccctgaatggggctgatcctgttgaacaatgggccatcccagtggcacgtattgagcctggtcaggggtggtgcagtttcaatggggttgggtcaaggttgagatctggccagctcctggtggtgcttcaggccagtcctgtgacccatgggctttgggctaagggggcatcccatgtcccatgggggtcacctgttctccatgtttgagtggcagtaacagtggcattctgaggtgggaaggtccactgtctagggtgttgtaccgggaatttgccaccccgccttcttagccaaggggtcacctccagggtctcgggatcttgggcccaaggaaacgagaagataccatgtggcccttgattggccgagtgtggcccagctctgtgtttgagaggtgtgggatatgaatggggtcccaccagtgaaagctcatggcccaggtccccaggctgtgatttttagtgcacacttggggagggctcctcagtgggtgcccaccacgcccagaggcaggctatgtgactgccaggtctgcaacggtgcatagcttccaggctaccctccttggttggctgggagcgggttggtggccatggcccatgcccagtggtcacagggcaaccctgggatcatgcaggggagctggtgagggcagtggaggtgctctccggaacggaagtatggctcagcccaggtatctggcccaaacccaatgaccagcctgccttgtttctcagggtttggtgatggggagggccaagggtgccctgcatctgtgatgggtctgttccacatagaacccattacaggggatcccttctccacatggagatgtgaggccctatttggacacatatcctcctcctgtccccccagatggtgagcctggaggaagatttgcattgggcccaatggccctgggccagtgtctgtcagccagtttcccagcccctggtgcactgaagctcaggcctttcctggcatcctggcctcctgcactgagctgtggtgagtatatcatggtcctgctggatgcatgtgcagggagggaaggtgccttgggttcagtcagtgtcgagaaccttatattgttctgaagagaggtggtgacttaaaaatcatgctcaataggattacgctgaggcccagcctagttgagaattttggaaggggacagtaggatcccgaagtccctggcagggcccttatattttaggctggagacttcaaggccctgaagggcacctggaggtggctcaacctgtctctgtgctcctccatgaggcagtccaggctccctctgtgggctttctgttggcactctggttccctgggccagggaacgttggtggctcctccctgagcccctgttctccccttgtgtctttcagtgagtgcttctgcccaggcaggccacttggcattgaccggtataggtgagtggatcctgctggggtcatgggtcatgagcaaggccacatgggtcgccgagggtcagccttacagccataagggttttctcagggagcccacctgaattcccaccggggaggcataggttctccaggagggcggcgttttggggaatcagacccaagggggacaccttccctgaagccctgcaagggtgatggtggtccaggcaggaaagggtttttttcagccccacacaaggcagctcctagctgagaatcggtgcttgggtcagacctcaaggattgcccaggccacatgagggcgactgagagcctccggggcaccacaggggtcacgtgggagctctcggtgcctggcgtgtgatgcacaaatggacctcttgggtttgttcatggagattcaaggatcgcaccccaccatgcccctgaatgggatggtccctcttgagaaatgggccatcccagtgggtctcctggagcctggttggggggtggcattgtttccctggggttgggtgaaggcagagttctggccggcacctggtggtgctgcaggtcagcactgggacccgtgggcgttgggccaaaggagagcccgaatcccactgggggtcaccctttttccaacatcaaatgtctggaagggtggcctcctgaggtgggaagtcctgctgttgagggacatgtcctgggaatttgtcactcaagcttcttctgagctttggtgtcacatccagggtggcagggtcttgggtccaagcaaagcagagggcaccatgtgtctcctgattggccaagtgttgctggctctgtgtgggaggtgtgcagagtatggatggggacccacgagagaaagcacgtagcactgcaactccaggctatgatttctgttgcatgcttggagagggtgcctggacaagcgtgccatgcccaggggcaggctgggcaactaccaggtcttcagcggagtgtgacatctgggccagcctccttggttggccgtgacctggttggtggcccggctctgtgcctactggccccagggcagccctgggatcatgcaggggagccattttgaacagtggaggtgctcttggggcctgtagtatggcacagcctaggtgttttgctcaagcccagtgacccacctgccctgtcctctccgggatcggtggaagggagggccaaaggtgctccgtgtacttgatgagtcagtatttcacattgaactcatcacatgtgtccatggagggtgagcaagggtgagatggcactgctgacccccttccccacgtagaggtcagtttggacacttgtcttcctcctgtctccccacatggcgaccccagaggaaaacttgtgttgggcccgctgtcactgggccaatgtcagtcagccaggtgcccagcccctggtgcgctgaagcttgggcccttctggcacccttggctcctgcactgagctgtggtgagcccatctgggtcctgctggatgcatgtgcagggagggggatacctgggttaggtcgattatgagaaccttatattgtcctgaagagaggtgatgacttaaaaatcatgcccaataggattacgctgaggcccagcctaggtgagagttttggaagaggatgctgggattctgaggtccctgacagagtaaatgtattttgggctggagaccttgaggccctgaagggcatctggtgggcccacccctatctctgtgctcctccgtgaggcagcccaggctccctgtgctggcttggtatctgggctccggatccctggttatggggcatgttggagtctccttcctgagtccccgttctcccctgtgtcttttggtgagctcttctgcccaagtggtccccgcggccttgagcggcataggtgagtgcatcctgtttcggtcatgggccatgagtgatgcagcatggggtcctcgacattcagccttcgggccactagggttttctcaggctgccaacctactccccaccagggagcaatggtttctccaggagggccacttccttgggaatctgacccaaggagcacatctttcctgaagccctgcaggggtgacagtggtccaggcagcaaagggttccttcagcccaatgtagggcagctcccagctgaaactcggtggacagctcaggcctggagtactgtccagggcacatggggaggaggggcacagggaatgtggcgcaccctagaggttacactggagttctctctccctggagaggggtgagtgattgggcccacacagtcaggctgtgaagattcaaggaatgctccacacccatggccttgaatgggaccaaccctgttgagcagtgggccatcttatggtacctccttgagtctggtgagggatggcactgtttcagtgaggttgggtcaagactgagctctggctggcacctggtgctgctgcaggccctgggacttgggggccttcagtcaagggggcagctctgatcctgctggggacaaaccttccttgaggtccagtggtgaagagtgtcctcctaaggtgggaaggcctgctgtcaagggaatttgccacccaggctgcttctgagccttggggtcacctcagggtggcagggtcttgtgcccaaggaaaggagaagacaccatctggttcctgattggctgagtgtagccgggctctgtgtgtcggagttgggcagggcatggatggggacccaccagagaaagtgtggcccaggggccccccaggcttggagagggcaccagggccggtgcccacaatgctcaggtgctggctctgggagggccaggtctgcagcggcttttggcatctggccaaccaccttggttggccaggagctggttgatggccctgtcctgtgtcctgtgccctgtgccctgtgtccctggtatggccctggggtcatgtgtgggagctggcctgagcagtggaggtgctcttggggcctgcagtagggtacagcctaggcatcttgcctgagccagcactgtcttttgctttccctgtctttccagggtttggtggcagagagggcaaaggatgccccacatctgtgttgggtcagtgttcagcatggatcccatcacatgggtatcccttagccccttccctgcattgatatgtgaggccctggttggacacatgtcctccttctgtccctctagatggtgagcctggaggaagatgtgtgggacccgcaggccgagggccagtgtctctcagccaggtgctcagcccccagtgggctgaaactctgacccttcctggcaccctgctctcctgcactgtgctgtggtgagcacatccgggttccactggatgtttgtgcagggagggggttccctgggttgggtcaatgatgagaacagggccacatgaggggggccagaggggctacagagtgccatggggtaacaagggagctcttggtccctggagtgtggtgtgtgaatgggcccatggggttgggtagcagagattcaaggatcctgctctacccatggccctgaatgtgaccatcgctgttgagcaatgggccatcccagtgggtctcctggggcctggttggggggcggagttgtttccctgggattgggtcaaggttgactctggctggcacctggtggtgttgcaggtcagccctgggactcatgggctttgggccagggacagcccgcatcccgctgggggtcacccaagtgttgtgaagggtggcctcctgagttgggaaggcccgctattgaggcatctgtactgggaatttgttgctcacgctgcatgggagccatggtatcacctccagggtggcagtcttgggaccaagcaaaggagggggcagcatgagactccggattggctatgtgtgactggctatgtgtcttggaggtatgtggagtatggatggggacccaccagagaaaacaagtgaccctgaggccccatgctgtcttttctggtgcctgcatggagagggtgcctgtacgcatgcccaccatgcccaggggcaggctgtgccactgtcaggtctgcagtagcatgtggcatctgggccagcctccttggttggctgtgacctggctggtggcccggacctctgcccagtggtcccagggcagccctagggtcatgcggaggagcagttttggccagtggaggtgcccttgggtcctgcagtcgtgcataccctgggcgttttgcctgagcccagtgacctacctgccttgtccttcccgggttcggtggcagggagagacacttgcataggtgatgagtcagtatttcgcatggatctcatcacatgtgtccatggagggggagcaagcgtgagctggcacccaacacccctttctccacatggagggtggtcacatgttctccacctgttcccctagatggtgagacttctgttgggcttgcttttcctgggccagtgtccatcagccaggtgctcagccatcggtgcgctgaagctccagcccttcctggtgccctgatctcctgcactgagctgtgatgagtacatccgggttccactggatgcatgtgcgggaaggggggtgccctgggttgggtcagtgatgagaaccttatattgtcctgaagagaggtgatgacttaaaaatcatgctcaataggattacgctgaggcccagcctgggggagaattttggaaaaggatgctgggatcccagggtccccaacagggccactgtattttggacctgggacctggtggctctgaagggcatctggaggtggcccaacctgtctctgcactctagtttccctgtgtgggcttggtgtcggtgctccagttccctgggggcagggaatgttgatggctccttcctgagtccctgttctcgcctttgtctttcagtgagctctttcacctaggagggccccttggcattgactggcataggtgagtggatcctgctggtgttatggatcatgagccagaccatatggggtccccaaggatcagcctttgggccacaagggttttctcagggagctgacctgaatttccacctgagacggaaaggttctcctggaaggcaggctttttggaatcggacccaaggaggacaccttctctgaagccctgaaggggtgatggtggtccaggcaggaaagggttccttctgcctaacataggacagtgcctagttgagactcggtgctgcagtaaggccttgaggactgcccaggctacatgaggggggccagaggggctacggggcaccacagggttaatggtgacctcttggtccccagagtgtggtgcgtgaatggacccatggtgttgggttgtggagattcaaggatagtgccccacctatggccctgaatgcaactgtccctgtttagcaatgggccatctcagtgggtctcctggagcctggtggggggcagagttgtttccttgtgactgggttaaggtagagctctggccagcacctggtggtgtggcaggtcagccctgggactcttgggcttttgaccaaggggcagcctgtatcccgctgggggtcatcctatctctgaggtcaagtgtcgtgaagggtggcctcctgaagtgggaaggctcgctgtcgagggacctgtcctaggattttattgctcaggctgcttctgagccatggtgtcacctctagggtgatggggtcttgggaacaagcaaaggggagggcaccatgttgctccggattgggcaagtgtggcccagctctgtgtgtgtgaggtgtgcagaacatggatggtgacccaccagagaaagcacatggccctgtagctctaggttgtgatttccgtgcacacttggagacagcatcttgatgtgtgcccaacacgcccaggggcagactatgcgatagccaggtctgcagcggtgtgtggcatctgggccagccacctttgttggccatgagctggctcatggccctgacccatgcccactggtgtcagggggccctggcgtcgtgtgaggagccatctgtggcagtggaggtagactcagggcctgcagtatggcgcaacccatgcattttgcctgagctcagtgacctacctgccctgttcctccagggtttggtggcagggggagccaagggtgccccacattggtgacgagttagtacttcacatggatctcataacatgtgtccgtggagggcaagcaaatgtgagcccgcacccactactgccttccccacatggaggtcagtttggacacatatcatcctgctgtcccccaaatggtgagaccgaagaagacttgccctgggccctctgttcttgggccagtgtcagtcagccaggtgcccagctctaagtgcgctgaagcttgggcctttcctggaatgctcggctcccgcactgagccagggtgagcacatccgggtactgctggatgcatgtgtggggcaggggtgcgccctgggttgggctgatgatgagaaccttatattgtcctgaaaagaggtgatgacttaacaatcatgctcaataggattacattgaagcccaggataggtaagaattagggaagatgatgcagggatcccaagatctccagctagaccacacttattttgcactggagaacttgagaacttgaagggcatctcaggggagcccaaccctgtctctgagctccttcgtgaggcagcccaggctccccttgcgggcttggtgtctgtgctccgcttctccagggacagggcaatttggtgttccttcctgaatgctccttcttccctgtgtccttcagtgagctcttctgcccaggtggggtccctagctttgagcggcataggtcagtgcatcctgttggggtcatgggccatgagtgaggcagcatggggttggtgagagtcagccttcaggccactagggttttctcagggagccaaccgattactcaccgggagggatggttcctccaggagggtcacttcttgggaatctgaccctaggagcacacatttcctgaagctcggcagggagatggtggtccaggcaggaaagggttccttcaacctaacgtagggcagttcccagctgaaactaggtgggcaggtgaggcttgaggactgcccagtccacatgaaaggggccacaggggctttggggtgccctgggagtcatgctggagttcttcccccaagagggatgggtgatagggtccacgtggtcaggctgcggagattcaaggaatgccacccacccatggccctgaatgggaccaaccctgttgagcaatgggccattttcggcatgtttcaatgcagttgggtcaaggctgagcgctggctggtgcctggtggtgctgcaggccggccctggggctcatgggctttatgccaagggggcaactcccatcccactggggtaatcccttccttgaggtccagtggtgggaagggtggcctcctgaggtgggcagacctgctgtcaagggacctgtcctgggaatttgccacctaggctgcttctgagccatggggtcacctccaggatggcggggtcttcagcccaaggaaaggagaggacaccatgtggtttctgattggctgagtgtggcctggctgtatgtgtgggaggtgtgcagggcatggatggggactcatcagagaaagaatgtggccctggaggcccccaggctttgatttctggtgtgtgcttggagtgggcaccagggtggccctaccatgcccaggggcaaggtctttgcctgccaggtctggagtggctcctggcatcaggaccaccctccttggctcaaccaaccttcagcaggttggctgccttggcccgtgccccatggtcccggtacgaccctggggttgttcgggggatctggcccaggcagtggaggtgctcttggggcccacagtagggcacagcccaggcctcttgccccagcccagtaacccacttgccctgtctttccagggttttgtggcagggaaggccaagggtgctctgcgtccatgttgggtcagtgttctgtaaggattccattacaagggtatcccctacccaccttccctacattgatacatgaggccctggttggacacatgtcctcctcctgtccctacagatggtgaccctgaagaaagacttcagttgggcctgaaggccccgggccagtgtccatcatccaggtgctcagctcccagtgcactgaagctcagacccttcctggttccctggtctcttgcactgagctctggtgagcacaactgggtgctgctggatgcatgcatggggaggggggtgccctgggttggggtggtgatgagaaccttgtattcttctgaagagaggtgatgacttaaaaaccatgctcaataggattacacttaggccgaacctaggtgagaatgttggaagaggacgttgggatcctattatccctggcagagccactgtattttgggctggagacctggaggccctgaaagggcatctggagggggcccaaccctgtctctgtgctcctgcatgagggtccccaggctccctgtccagccttggtgttggtgctctggtaccctggggatggaacaagttggtggctctttcctgagcccccattctccctttgtgtctttcagtgagcttttctgcccaggtgggcaccctggcattgattagcctccttggttgtccatgacctggctggtggcccgatcctgtgcccagtggtcccagggcagccctggcatcatacggggcagctgttttgggcagtggaggtgctctccaggcctgaagtatggcacagcctgggcattttacctgagaccagtgacctgcctgccttgtccttcctgggttcggtggcagggagggccaagggtgccctgcgtcagtgatgagtcagtattttgtgtggatctcatcacctgtccatggagggaaagcaagcatgagctggcacccaacacccccttctccgcatggagggtggtcacatgtcctccacctgtgcccccagatggtgagacttgaggaagacttccactgggcctgcttttcctgagccagtgcccatcacccaggtgctcagtccctggtgcactgaagctccagcccttcctggcgccctggtctcctgaactgagctgtggtgagcacatccgggtttcactggatgtttgtgcggggagggggttctctgggttgggtcaatgatgagaaccttatattgtcctgaagagaggtgatgacttaaaaatcatgctcaataggattacgctgaggcccagcctaggggagaattttggcagaggatgccgggatcccaagatttccgggagggccacttgtattttgggttggagacctggaggccctgaagggcgtctggaggtggcccagtgctttctttgcgctcctctgtgaggcagcccaggctccctttgtgggcttggtgtttgcgctcctcttctccagtgatggggcacgttgggggctcctccctgagtcctggttctccccttgtgtctttcagtgagctcttctgccaagcggttcccctggcattgaccaacataggtgagtggatcctgctggcatcatgggctatgagctaggccgcatgggtttgctgagggtcagacttcaggccccaagggtttcctcagggaaccgacctcaattcccaccatgtgactgccaggtttgcaacagtgcatagcttccgagctaccctccttggttggccgggagctggttggaggctgtggcccatgcctagtagtcacagggcaggcagactgccctgttttttcagggtgtggtgacggggagggccaagggtgccctgcatccatgatgggtcagggatttcaggagggatggtttctccaggagggcagcttccttgggaatcttacccaaggaggatgtcttccctgaagccctgcaggggtgacgatggtccagatagcaaaggtttccttcagccccatgcaggacatcacctagttgagatatggtatgtgggtcaggccttgaagactgcccaggccacctgaggggcccagaagggctctggggtgccacaggtgttatgtaggagctctcagtccccagacttgtttcgtggggttggtgacggggttgggttgtggaggttcaaggatttcatcccacctgtgaccctgaatggggccaaccctgttgagcaacaggccatcccaatggcacgtattgagcctggtggggtgtggtgcagtttcaatagggttgagtcaaggctgagatccatctggtgcttggtgctgctgctggccagccctgggacccgtgggctttgggctaagggggtagcccacatcctattgagggtaacccattctccgagtttgagtaacggttaacagtggcattctgaggtgggaaggcccactgtctagggtcctatactgggaatttgccaccccgggttcttctgagacaagtggtcacctccagggtcatggggtcttgggcccaaggaaaggagaagataccatgtggcccttgattggctacatgtggcccaggtctgtttgggaggtgtgtgggatgtggatggggtcccaccaatgaaagcacatggcctgggtccccaggctgtgattttcagtgcacacttggagagggtgcctcggcgggtacctaccacatccatgggcaggctatgtgactaccaggtttgcaacagtgcatagcttccaagctaccctccttggttggtcgggagctggttggaggctgtggcccatgcctagtggtcacagggcaggcagacggccctgttttttcagggtatggtgatggggagggccaagcatccatgatgagtcggtgttccacatggaacccattacgtgggtatctcttaccccttcctcatatggagatgtgaggccctatttggacacatatcctcctcctgtacccccagatggtgagcctggaggaagacttgcgttgggcccaaaggccctagaccagtgtctgtcagccaggttcccaacccccgatgcgctgaagctcaagcctttcctggcaccctggtctcctgcactgagctgtggtgagtatatcctggtcctgctggatgcatgtgcagggaggtgggtgccttgggttgggtcaatgatgagaaccttatattgttctgaagagaggtgattatttaaaaatcatgctcaataggattacgctgaggcccagcctagttgagaattttggaggaggacactgggataccgaagtcccccgcagggactctgtattttgggctggagaccttgaagccctgaagggcatctggaggtggcccaacctgtctctgtgctcctccctgaggcagcccaggctccttttgtgggcttggtgttggggctccagttccccaggtcagggaatattggtagctctttactgagcccctgttctccctttgtgtctttcagtgagctcttctgcccaggcgggccccctggaattgatgggtataggtgagtgcatcctgctggggtcatgggccatgagccaggccacgtggggtcaccaggggtcccccttctggccatgagggttttctcagggaaccgacctgaattaccactggggaggcataggttctccaggagggcggctattttgggaatcggatccaagggggacaccttccctgaagccctgtgggtgtgatggtggtccaggcaggaaagggtcccttccaccccacacagggcagctcatagctgagagttgatgctcaggtcaggcctcaaggatttcccaggccacatgagggggacagaggagctctgggtgccacgggggtcacataggagctctcagtattcggtatgtcatgcacaaatgggcctcttgggttggattgtggagattaaaggatcgcgcaccaccgtggccctgaataggaccatccttattgagcaatgggccatcccagtgagtctcctggagcctggtggaggggagggggtggcattgtttccctggggatgggtcaaggcagagctctggccagcaccttgtggcttctgcaggtcagccttgggactcatgggcattgggccaagggggagcccgcgtcccactgggggtcaccctttttccgacgtcaagtatctggaagagtggcctcctgatgtgggaaggcctgctgtcgagggacgtgtcccaggagtttgtcgctcaagtttcttctgagctttggggtcacatccagggtggcggggtcttgggcccaagcaaagcagagggcaccaagtgtctcctgattggccatgtggctgtctctgtgtgtgggaggtttacagagtatggatggggacccaccagaggaagcacgtggccctgcagcaccaggctgtgatttctgttgcacacttggagaggttgcctggacacgtgcccttcatgcccagtgacagactatgcaactaccaggtctgcagcagggtgtgacatctgggctagcctccttggttggccgccacctggctggtggcccggatctgtgcccaacagtcccagtgcagcactggggtcatgcaggggagctgttttggacagtggaggtgctctcggggcctgcaatatgatgcagcctgggcgttttgctcaagcccagtgacccacctgccctttcctttctgggttcagtggaagggagggccaacagtgtagtgcgtacttaacaagtcagtatttcacattgaactcatcacatgtgtccatggagggcaagcaaaggtgagctggcacccccgacccccttccccaaacggaggtcagtttgggcacacgtctccctcctgtctccccagatggtgaccccggaggaaaatttgtgttgggcccactatccctgggccaatgtcagtcagctaggcacccagcccccagtgcgctgaagctcaggaccttcctagtgccctcggctcctgcactgagctctggtgagtccatctgggtcctgctggatgcatgagctgggggcgggagggtgccctgggttgggtcagtgatgagaaccttatattgtcctgaagaaaggtgatgacttaaaaatcatgctcaataggattacactgaggcccagcctaggtgataattttggaagaggatgctggaattctgaggtccctgacagagcagctgtattttgggctggagaccttgaggccctgaagggcatcttgtgggcccacccctatctctgtgctcctctgtgaggcagcccaggctccctgtgctggcttggtatccgggctctgggtccctggtgacggggcatgttggaggctccttcctgagcccctgttctcccttgtcattcagtgaactcttctgcacaagtgacccccccagccttgagcggcataggtgagtgcatcctgttttggtcatgggccatgagtgatgcagcatggggtccctgacattctgcctttgggccaccagggttttctcaggctgccaacctactccccaccagggagcgatggtttctcaggagggctgcttccttgggaatctgacccaaggagcaagtctctcctgaggccctgcaggggtgacagtggtccaggctggaaagggttccttcagcccaatgtagggcagctcccagctgaaactcagtgggcaggtcaggcctcgagtattgcccaaggcacatgggggagtgaggcacgggggatacagtgcgccgtggaggtcacactggagttctcccctccctggagagggatgagtgactgggtccacacggtcaggctgtggagattcaaggcatgctccacacccatggccttgaatgggaccaaccctgttgagcaataggccatcttagtggcacctccttgagcctggtgggggacggcactgtttcaatgaggttgggtcaagagtgagctctggctggcacctggtggtgctgcaggccctgggacttgtggactttgggccaagggagcagctctgatcctgctggggacaagccttccttgaggtccagtggtgaaaagagtgtcctcctgagatggcaaggcctgctgtcgagggacctgttctaggaatttgctgcccaggctgcttctgagccttggggtcacctcagggggtggcagggtcttgagcccaagaaaggaaaagacacgatgtggttcctgattggctgagtgtgacccggctctgtgtgtcagagttgggcaggacatggattgagacccaccatagaaagcatgtgatcctggaagcccctaggcttggagagggcaccagggccagcgcccaccacgcctaggtacgatctctcggacttccaggtctgcagcggctcttggcgtctgggccagcatgcttggttggccaggggctggttggtggccctgtcttgtgccctgtgtccccggtatggccctggggttgtgtgtggtagcaggcctgggcagtggaggtgctcttggggcctgcagtagggtgctgcccaggcatcttgcccgagccaggtgacacgcttgccctgtctttccagggtttggcggcagggagggccaagggtgcccagtgtccgtgagggatcagtattcagcatggatcccatcacatgagtatcccttagccccttctctacattgatgtgtgaggccctggttagacacatttcctcctcctgtccctccagatggtaagcctggaggaagacttgtgttgggcccacaggccccaggccaatgtctgtcagccaggtgctcagcctctggtgcgctgaaactctgacccttcctggcacactggtctcctgcactgagctggggtaagcacatctgggttgcactggatgtttgtgtggggagggggttccctaggttgggtcaatgatgagaacctgatattgccctgaagagagatgatgacttaaaaatcatgttcaataggattacgctgaggcctagcctaggtgagaattttggaagcagatgctgggatcccaaggtcccttgcagggccatcgtatgttgaactggagacctggaggctctgaagggcatctggaggtcgtgcaacctgtctctgcactcctctgtgaggcagcccaggctccctgtgtggggttggtgttggtgctatggttccctgggggtggggaacattggtggctccctccagagcccctgttctcaccttgtgcctttcagattttccacctaggaggtccacctggcattgactgacataggtgagtggatcctgctggggtcatgggtcatgagccagaccatggggggatcccagagattcagtctttgggcaacagttttctcagggagcagacctgaatttccacctgggagggaagggttctcctggagggcgacttttttgggaatcggacccaaggaggatgccttccctgaagccctgccggggtgatggtggtccaggcaggaaagttccttctgctcaatgcagggcagcacccagctgagactcggtgctccggtaaggcctccagaactgcccaggtcacataaggggggccagaggggctacgaggtgccacggggtaacaggggagctcttggtccccagagtgtggtgcatgaatgggcccattccgttgggtctcagagatttaaggattgcaccacaccatggccctgaatgcaaccgtccctgttgatcaatgggccatcccatgggtctcctggagcctggtgggaggcagtgttgttttcctggggttgggtcaaggcggagctctggctggtacctggtggtgctgcaggtcagccctgggacttgtgggctttgggccaaggggcatcccgcatcccgctgggggccaccctttctccatggtcgagtgtcgtgaagggtggcctcctgagttgggaaggcttgctattgaggcacttgtactgtgaatttgttgctcaggctgcttgggagccatggtgtcacctccagggtggcagggtcttgggaccaagcaaaggagtgggcaccatgtcactgcagataggccatgtgtgactggctctgtgtctgggagatatgtggagtatgaatggggacccaccattcatagagaaagcaagtggccctgcagcccgaggctatgatttccggtgcacacttggagagggtgcctttacacccaagtaccaggctcagaggtaggctatgccactatcaggtctgcagtggcacgtggcatctgggccagcctccttggttggccatgacctggctggtggcctgggcctgtgcccagtgttcccagggtagttctagggtgctgcgggggagctgttttggctagtggaggtgctcttgggtcctgcagtacagcacagcctgggcgttttgcctgagcccagtgacctgcctgccttgcccttcccaggatcggtggtagggaagaccaggggtgcccggcataggtgatgagtcagtatttcacatggatatcatcacatgtgtccatggagggggagcaaacatgagctggcacccgccacccccttctccacatgaagggtggtcacacgttctccatctgttcctccagatggtgagacttctgtcggcctcgcttttcctgggccagtgtccatcagccaggtgctcagccccagtgcactgaagctccagcccttcctggcgccctggactgagctgtggtgagcacatccgggttccactggatgcgtatgtgggaaggggggtgccctgggttgggtcaatgatgagaaccgtatattgtcctgaagagcggtgatgacttaaaaataatgctcaataggattacgctgaggcccaccctaagtgagaaatttggtaggggatgttgggatcccgagatttctggcagggccactgtagtttgggttggaggcctggaggccctgaagggcatctggaggtggctcaactctttctctgtgctcctccgtgtagcagcccaggctccctgtgcgggcttggtgttgttgcttctgttccttgggggcagggcatgtgggtggctcctccctgagccccagttctccccttgtgtctttcagtgagctcttctgccaagggggtcctcctggcattgaccaacataggtgagtggatcctgctgctgtcatggtccgtgagccaggctgcttggggttgccaagggtcagacttcgggccatgaaggtttcctcagggagctgaccctaattcccatgagggaggcatggtttctccaggaggtcagcttccttgggaatctgtgacttgacagggttgagtcgcagaggttcaaggatctcatcccacctgtaaccctgaatggggcccaccctgttgagcaactggccatcccagtggcacatattgagcctggtggggggtggtgcagtttcaatggggttgggtcaaggctgagatatggctggtgcctggtggtgctgcagtccagccctgggatccgtgggctttgggctgagggggaagcctgcatcctattgggggtaacctgttctccaaatttgagtgattggtgggaaggcctactgtctgaggtcctgtactgggaatttgccacctcagcttcttctgagccatagggtcacctccagggtcatggggtcttgggaccaaggaaaagagaagataccatgtggcccttgattggccgagtgtagcccagctctgtgtttgggaggtgtgtgggatgtggatagggtcccacctgtgaaagcatgtggcccgggtccccaggctgtgattttcagtgcacacttggagagggcaccttggtgggtgcccaccatgtccaggggcaggctatgtgactgccaggtttgcaatggtgtgtagcttccttctaccctccttggttggctgggagtgggttggttgctgtggcccatgcccagtggtcacagggcaggcagactgccttgttttttcagggtatgctgacagggagggccatgggtgccctgcattcatgatgagtcagtgttccacatggaacccattatgtgggtatctcttattccttctacatatggagatgtgaggccctatttggacacatgtcctcctcctgtacccccaggtggtgagcctggaggaagacttgcattgggcccaatggccctggaccagtgtctgtcagccaggttcccagcccccgatgcgctgaagctcaagcctttcctggcaccctggtctcctgcactgagctgtggtgagcatatcctggtcctgctggatgcatgcgtggggaggggttgtcctaggttgggtcaatgatgagaaccttataatgttctgaagagaggtgatgacttaaaaatcatgctcaataggattacgctgaggcccagcctaggtgataattttggaagaggacactgggtcccgaagccccctgcagggcccctgtgttttgggctggagaccttgaggccctgaaaggcatctggtggacccaactctatctctgccctcctcaatgaggcagcccagcctccctgtactggcttggtatccgggctccgggtctctggggacggggcacattggaggctccttcctgagcccccattctctcctgtgtctttcagtgagctcttcggcccaagtggtccccccggccttaagcggcataggtgagtgcatcctgttttgatcatgggccatgagtgttgcagcatggggtccccgacattcagccttcaggccactaggcttttctcaggctgcaaacctactctccaccagggagcgatggtttctcaggagggccacttccttcggaatctgacccatggagcacgcctttcctgaagccctgcagaggtgacagtggtccaggcaggaaggggttccttcagccccaatgtagggcagctcccagctgaaacttggtggacagatcaggcctggagtactgcccagggcatatggggaggagggacacagggaatgtggcgcaccctagaggtcacactggagttctgtctccctggagaggggtgagtgattgggcccacatggtcaggctgtggagattcaaggaatgctccacaccgatggccttgaatgggaccaaccctattgagcaatgggccatcttagtggcacctccttgaacctggtgggggatggcactctttcaatgaggttgggtcaaggctgagctctggctggcacccagtggtgctgcaggctggccctgggacttgtgggctttgggccaagggggaagcttccatcctgctgggaacaacccttccttgaggtccagtggcaggaaggggggcttcctgaggtggaaagccctactgttgagggacctgtcctgggaatttgctgtccaagctgcttctgagccatggggtcacctctagggtggtggggtcttgagcccaaggaaaggagaggacaccatgtggttcctgattggctgagtgtggcccggctctgtgtgtcggagttgtgcagggtatggattgggacccaccagtgaaagcacatggccctggaggtccgcaggcttggagagggcaccagatctggcacccaccatgcccaggtacaggctctgggactgccaggttgcagcagctcttggcatctgggccaccctccttggttggccaggagctagttggtggccctgtcccatgccccatgtccctggtatggccatggggtcatgcagaggaaccggccctggcatggaggtgctcttgcaacatgcagtagggtgcatcccaggcatcttgcctgagccaggtgacccgcttgccctgtctctccagggtttggtggcagggagggccaagggtgccccgtgtccatgttgggtcagtgttcagcatggatcccattgcatgagtatcacttagctccttcccagcattgatatgtgaggccctggttggacacttgtcctcctgtccctccagatggtgagcctggaggaagactcgtgttgggcccacaggccccaggccagtgtacgtcagccaggtgctcagcccatggtgtgctgaagctctgacccttcctgactccgtggtctcctgcactgagctgtgatgaccatatccaggtcctgctagatgcatgcgtggggaggcagggtgccctgggttgggtcaatgatgagaaccttgtattatcttgaagagaggtgatgacttaaaaatcatgctcaataggattacactgaggcccagactaggtgagaattttggaagaggatgctgggatcctgaggtccccaacagggccaccatattttgggctggagacctggaggtcctgaagggcatctgtagggggcccaaccctgtctctgcactcctccctgaggcagcccatgctccctattcgggatcggtattggtgctccacttccctgggggcaggacacgtgggtggctactccctgagcccccgttctccccttgtgtctttcagtgagctcttccaaacaggtgggctccctagcattgaccgacagaggtgagtggatccttctgggattatgggccatgagccaggccatgtggggtccccaaggttcagcctttggatcccgagagttgtctcagacagccaacctgatttgccacctgggagagatggcttctccaggagggtgggtttttgggaattggacccaaggaggacgccttccctgaagccctactgggatgatggtggtccaggcaggaaagggttccttcacccagctgagactcggtgttccagtaaggcctcaaggacctccctgccacatgaaggggcccagaggggctacgaggcaccacaggagtgacaggggagctcttggtccccagagtgtggtacatgaatgggcccatggggttgagtcgcagagattcaaggatgctgcaccacccatggccctgaatgtgactctcctcctggagcctggtggggggtggcgttttttccctggggttcggtcaaggtggaactctggtcagtacctggtggtaatgtaggtcagccctgggactcgtgggctttgggccaacggacagcccacatccctctgggggtcaccctttctctgaggtcgagtgtcgtgaagggtggcctcctgaggtgggaaagcccaatgtcgaaggacctgtactgagaatttgttgcttaggctgcttaggatccatgttgtcacctccagggtggtgggatcttgggaccaagcaaaggagagggcaccatgtggctgccagtggctatgtgtgactggctctgtgtctgagaggtgtgtggatggggacccaccagagaaagcaagtggccctgcagccccaagatgtgatttctggtgcaggcttggagagggtgcctatacctgctcccaccacgcccaggggcaggctttgccactgcaggtctgcagtgccacgtggcatctgggccagccaccttggttggccgtgacctggctggtagcccgtgcctgtgcccagtgttcccagggctgccctggggtcttgctggggagctgttttgggcagtggaaatgctcttggggcctgcagtatggcacagcctgggggcattttgcctgagcccagtgacctgcctgccttgtccttcctgggttcggtggcagggagggccaagggtgccctacattggtgacaagtcaatattttgcatggatctcatcacgtgtccatggaggtgggggcaagcgtgagctggcacgcaccccattctccccatggagggtggtcacatgtactccacctgtgtccctagatggtgagactggaggaagacttccattgggcccacttttcatgggacagtgtccatcagccaggtgctcagcccccagtgcattgaagacccagcccatcctggcaccctagtctcctgcactgagctgtgctgagcacatctggcttccactggaagttttttttgcgaggaggggcttccctgggttgggtcaatgatgagaaccttatattgtcctgaagagaggtgatgacttaaaaatcatgctcaataggattacgctgaggcccaacctaggggagaattttggaagaggattatgggatcccaaggtccccaacaaggccactgcattttgggctagagacctggaggctcttaagagcatctggaggtggcccaacctgtctctgctccttcgtgatgcagcccaggctccctgtgtgggattggtgttggtgctccatttccctggcatggggaatgttggtggctccttcctgagctcctgttctcgccttgtgtctttcagtgagctctgccacccaggacatccccctggcattgactggcataggtgagtggatcctgctggggtcattggtcatgagccagaccatgtggagtccccaaggttcagcctttgggccacaaaggttttctcagggagcagacctgaatttcacccgggagggaagggttgtcctggagggtggcttttttgggaacctaacccaaggaggacccattccctgaagccctgcaggggtgatggtggtccaggcaggaaagggttccttctgctcaatgcagggcaacacccagctaagatgcggtgatctggtaaggcctccagaactgcccaggccatatgaggggggccagaggggctacagggtgccacaggggtaacaggggagctcttggtccttggagtgtggtgcctgaatggacccatgggattgggttgtgtagattcaaggatcacaccctacccacagccctgaatgtgactcttcctcttgagcaatgggccatctcagtgggtctcctggagcctggtcggggggtggtgttgtttccctggggttgggtctaggtggagctctggctggtacctggtggtgctgcagatcatccctgggacttttgggctttgggccaagggacagcccgcatcccgcttggggtcagcctatctccatggtcaagtgtcatgaagggtggccccctgaggtgagaaggcctactgtcaagggatctgtcccaggattttgttgctcaggctgcttctgagccatggcgtcacatccacagtggcagggtcttgggcctgagcatagcagagggcaccatgtcgttctggattggccaagtatggcctagctctgtgtgcgggaggtgtgcagagcatggacggtgacccaccagagaaagcacgtggccctgcatcccaggctgtgatttccaatgcacacttggagagggtgtcttgatttgtgcccaccatgcccaggggcagactacgtgatagccaggtctgcagcctgagccacgtgtggcatctgggccagccaccttggttggccgtgagctggctggtggccttggcctgtggccagtggtgccagggcggccctggggtcgtgtgggggagccatgttgggcagtggaggtgctgtcagggcctgcagtacagtgcagcctgggcatttggcctgagcccagtcacccgcctgctctgttcctccagggtttggtggcggggagggccaagggtgccccgcatccgtgacgactcagtaattcacatggatcacatcacatttttccttggagggcaagcaaatgtgagcccccaccccccactgccttccccacatggaggtcattttggacacatatcctcctctagtccccctagatggtgagactggaggaagacttgcattatgcccgctgttcctgggccagtgtcagtcagccaggttcccagctccaagtgtgctgaagctcaggcccttcctggcaccctcagctcctgcactgagctggggttacatccgggttccactgtttgcatgcaaagggaggggtgtaccctgggttgggctgatgatgagaaccttatattgtcctgaaaaaaggtgatgacttaaacatcatgcttaatagtattatgctgaagcccaagctaggtgagaattttggaagatgaggctgggatcctgagatccccggcagggccacacttattttgggctggaaaatttcaagacctgaagcgcatcttgtgggggggcaatcctgtctctgtgcttctccgtgaggcagcccaggctcccgttgcgggcttggtgcccatgcttcgcttccccaggggtggggcaatttggcatcctcttcctgagccctccttcttccctgtgtctttcagtaagttcttcttcccaggtggggcccctggctttgagcggcatgggtcagagcatcctgtcagggtcatgggccatgagtgaggcagcgtcggttcgtcgagagtcagcctttgggccactggggttttctcagggagccaacaggttacccatcaggagggatggttcctccaggagggtcgcttccttgggaatctgactctaggagcatgcatttcctgaagctctgcagggtgatggtggtccaggcgggaaagggttccttcagcccaacataatgcagttcccagctgaaactcggtggcagatcaggctcaaggactgctcgggccacatgatgggggccacaggggatttggggtgccctgggggtcatgctggagttcttgccccaagaggggtgggtgatagggcccatgcgatcaggctgcggagattcaaggaatgctacccacccatggccctgaatgggactgaccctgttgaacaatgggccattttaatggtgcctccttgagcctggtaggtagtggcattgtttcaatgcggttgggtcaaggctgaactctggctggtgcccggtggtgcccacatgggctttgggccaagggggcagctcatatccctctggggtcaccccttccttgagattcagtggcaggaagggtgttctcctgaggtggaagacctgctgtcaagggacttgtcctgggaatttgccacctaggctgcttctgagccatggagtcacctccagggtggcagggtcttgagcccagggaaaggagacaccatatggtttctgactgggagtgtggcctggatctgtgtgtgggaggtgtgcagggcatggatggggacccatcagagaaagcatgtggccctgtaggcccccaggctttgatttctggtgtgtgcttgcagtgggcaccagggcagccctaccatgcccaggggcaggctctgtgactgccaggtctggagtggctcctggcatgaagaccacgctccttggttggccatgagcaggttggttgccctagcctgtgccctgtggtcctggtgcagccctggggttgtttggggagacagcaccggcagtggaggtgctctcaaggcctgcagtagggcgcagcccaggtgtcttgcccgagcccagtaacccacttgccctgtctttccagggtttggtggcagggagggccaactgtgccccgcatctgaaatggatcagtgttctgcatggatcccatcacaagggtatcccctacccaacttctgtgcattgttatgtgaggccctggttggacacatgtcctcctcctgtccctgcagatgctgaccctggaggaagacttgtgtcgggcccccaggccccaggccagtgtccatcagccaggtgctcagctcccagtgcgctgaagctcagacccttcctggcaccctggtgtccagcactgagctgtggtgagcccatccgggtcctgctggatgcatgaatggggaggggcctgcccagagttgggtcaatgatgagaaccttacattgtcctgaagagagatgatgacttaaaaatcatgctcaataggattacgctgaggcccagcctaggtgagaattttggaagaggacggctgggatcctgagatcccagtcagggtcactgtattttgggctggagacctggaggccctaaagggcatctggaagggggcccagccctgtctctgtgctcctccgtgaggcaacccacactccctgtgtgggcttggtgttggtgctctggttccccagggacagggcgggttggtggctccttcctgagcccctattctccctttgtgtctttcagtgagcttttccacccaggtgggccccctggcattgaccgacataggtgagtgcatcctactgggataatgggccactagatagtctgtgtggggttgctgaggtttagcctttgggccacaagggttttctcaggcagccaacctgaattcccacctgggagagatgggttctccaggaggcagcttttttgggaatcagacccaaggaggacaccttccctgaagccctgcaggggtgatggtggtccaggcaggaaagggttccttctgcccaactcgaggcccaatgcagggcagtgcccccctgagaattggtgctctggtaagggctcgaggactgcccaggccacatgaaggaggtcagaggggctatggggaaccatgggggcaacaggggagctcttggcccccggagtgtggtacatgaatgggcccatggggttgggtcacggagattcaaggattgcatctcacccacggccctgaatgcgaccatccctgttgagcaatgggccatcccagtgggtctcctggggcctggtgtggggtggcattgttttcctggggttgggtcaaggcggagctctgactggtacctgatggtgctgcaggtcagccctgggactcgtgggctttgggccaagaggcagcccgcatcctgctgggggtcgccttttctccgaggttgagtgtcgtgaaggatggcctcctgaggtgggaaggcccactgtcaaggcacctagactaggaattgttcctcaggctgcttgggagccatggtgtcacctccagggtggcgggatcttgggactaagcaaaggaggggacactacgtggctcccaattggccatgtgtggctggctctgtgcctgggaagtgtgtggagtatggatggggacccaccagagaaagcaagtggccctgcagtcccagaatgtaatttctggtgtaggcttggagagggtgcctatatgcatgcccaccatgcccaggagcaggctatgccacttcagggtctgcaggggcacctggcatatgggccagcctccttcgttggctgtgacctgggtggtggcctgtgcttgtgcccagtggtcccagggtagccctggggtcgtgcaggggagccgttttgggcagtggatgtgctctcgggtcctacagtacagcacagcctgggtgttttgctcaagcccagtgacctgcctgccttgtccttcccgggttcagtggcagggagagccaagggtgccccacattggtgacgagtcagtattttgcatggatctcatcacacgtgaccatgaaggacgagcaagcatgagctggcaccagccacccccttctccgcgtggagggtggtcacatgtcctccacctgtgcccccagatgatgagactggaggaagacttccattgggcccacttttcctgggccagtgtccatcagccaggtgctcagcccctggtgtactgaagctccagcctttcctggtgccccagtcttctgcactaagctgtggtgagcacatccgggttccactggatttttgtgcggggagggggttttctacgttgggtcaatgatgagaatcttatattgtcctgaagagaggtgatgacttaaaaatcatgctcaataggattacgctgaggcccagcctaggtgagaattttggaaggggattatgggatgctgaggtcctcagcaaggccactgtattttgggctagagacctggaggctctgaagggcatctggaggtggcccaacctgtctctgcgctcctccatgaggcagcccaggctccctgtgcagggttggtgttggtgctccggttctctggtgtggggaatgttggtggctccttcctgagccctcattctcaccttgtgtctttcagtgagctcttccacccaggagggccccttggcattgactggcataggtgagtggatcctgctggggtcattggtcatgagctagaccgtgtggggtccccgaggttcagccttcagtccacaagggttttctcggggagcagacctgaatttccacctgggagggaagggttctcctggagggtagtttttttgggaatctagcccaaggaggatgccttccctgaagccctgcaagggtgatggtggtccaggcaggagagggttccttctgcccaatgcaggacagctcccagttgagactgagtgctccagtaaggtctccaggactgcccaggccacatgaaggaggccagaggggctatggagcaccactggggtaataggggagctcttggtccctggagtgtggtgtgtgaatggggtttggtcacggagattcaaggatcacaccccacccatggccctgaaagtgaccatccctattgagcaatgggccatcccaccgggtctcctggagtctggtgcagggcgacgttttttccctggggttgggtcaaggtggagctctggtacctggtcatgctgcaggtcagccttgggactcgtaagctttgggccaagggacagctggcatcctgctggggggtcaccctatctctggggtcgaatgtcacgaagggtggcctcctgaggtgggaaggcccattgtcgagggacctgtcccaggattttgttgctcaggcttcttctgagccatggtatcacctccagggtgacagggtcttgggcccaagcaaaggagagggcaccatgtcgctctgagttggccaagtgtagcctagctctgtggtgggaggtgtgcagagcatggctggtgacccaccagagaaagcacgtggccctgcagccccaagctgtgatttccagtacatgcttagagagggcatcttgatgtgagcccaccacacccaggggcagactacgtgactgccaggactgcagtggcacatggcatctgggccagccttcttggttggccatgacctagctaatggccctggcccgtgccttggggtcatgcaggggagccctcttggacagtggaggtcctctcagggcctgcaatatggcgcaggctgggcatttggcccgagcccagtgacctacctgccctgtccttccagggttgggtggcagggagggacaagggtgccccatgtcagtgacaagtcagtatttcacatggatctcatcacatgtgcccatggaggacgagcaagcgggaactggcacccgctacttccttccctacatagaggccattttggacacatgttctccacctctctcccagatggtgagacgggaggaagacttgtgttgggcctgctgttcctgggccagtggccatcagcctgttgcccagcccctgaggcgctgaagctcaggcccttcctcacaccctggtctcctgcactagctgtggtgagcacatccgggtcccgctggatgcatgcaagaggtggttggtctcgtgggttgggtcgatgatgagaaccttatattttcctgaagagaggtgatgacttaaaaatcatgctcaataggattacgctgaggcccagcctaggtgagaactttggaagaggatgctgggatcctgagatcccaggcagggccactatattttggggtggagaactcaaggccctgaagggcctctcagggggtgccaccctgtctctgtgcccctctgtaaggcagcccaggctccctgtgtgggcttggtgtctggtctctggttccccgggggcggggcatgttggtggctccttcctgagcccgctttctcccccatgtctttcagtgagctcttctgcccaggtggggcccatggccttacacgacataggtgagtgtatcctgttggggtcatgggccatgaatgaggcagcatggggccatttagggtcagccttcgggccactagagttttctcagggtgcgaccggggagggaacatttctccagtagggtcacttccttggaaatctgatcctaggagcacgcatttcttgaagtcctgcaaaggtgatggtggtccagacaggagagggttccttcagcccaacatagcgcagctcccagctgaaactcggaaggctggtcaggcctcgaggactgcccaggccacatgaggtgggcaacaggggctctggggcaacctgggggtcacgctggagttctccctctctggacagtggtgggtgattgggcccacgcagacaggccccggagattcaggactgcaccccatccatggccctgaatgggaccgaccctgttgagtaatgggccatctcagtggtacctccttgagcctggtagggggagacactgtttcaatgcagttgaatcaaggctgagctctggctggtgcctggtggtgctgcaggcagccctgagggttgtggtctttgggacaaggggtagctcacatcccactggggtcaccccttccttgagattcagtggccaaaagggtgtcctcctgagatgggaagtcctgctgtcgagggacctgttctgggaatttgccacacaggctgcttctgagccacggggtcacctccagggtggtagggtcttgatcccaaggaaaggagaggacaccatgtggtttcttattgaccaagtgtggcctggctttgtgtgtgggaggtgtaacgcaagatgaggacccaccagagaaagcacgtggctctggaggcccccagggtttgatttccggtgtgtgcttggagagggcaccaggttgggcacccaccacgcccagggcaggctctgcgactgccaggtctgcattggctcctggtgtcagggccagactcattggttggccatgagcaggttggttgccctgacccatccccatggtcccagtgtggccctggggtttttcaggggagccggctcaagcagtggaggtgcgcttagggcctgcagtagggaacagcccaggcatcttgcctgagcccagtaacctgcttgccttgtctttccagggtttggtggccgggagggccaatgatgctctgcgtctgtgttggatcagtgttcttcatggattccatcacgtgggtatcccctacccaccttccccttgctcatacgtgaggccctggttggacacatgtccttctcctgtcaccccagatggtgagccttgaggaagacttgtattgggcccccacaggccccaggccagtgtccgtcagcctggtgctcacccccagtgtgctgaagctcagaccctccgtggcaccctggtctcctgcactgagctgtggtgagcacattcaggttccgctggatgcatgcatggagaggggcttgcccttggttgggtcagtgatgagaaccttctattgtcctgaagagaggtgatgacttaaaaatcatgctcaataggattacgctgaggcccaacctaggtgagtatgttggaagaagacactgggatcccgagatctccaacagggcactgtattttgggttggagacctggaggccctgaagggcatctggaaggaggcccaaccctgtctctgtgctcttccttggggcagcccaggctacctctgcgggcttggtgttggtgctccagttccctggggccagggaacattgctggctccttcctgagcccccattcctcccttgtgtctttcagtgaacttttcctcccagatgggccccctggcattgactggcataggtgagtgcatcctgctggggtcatgggccatcagccaggccatgtggggtcgctgaggttcagcctttgggccacaagggttttctcaggcagccgacctgaattcccacctgggagagacgggttctccaggagggcagcttttttgggaattagacccaaggaggatacctgaagccctgcaggggtgacggtggtccaggcaggaaagggttccatcagcccgggcaaggcagctcctagctgacactcggtgttcgggtcagtccttgaggactgcctgaacacgagggggtccagaggggctctgggtgccacgggggtcacatgggagctctcagtccctagagtgtggtgtgtgaatggacccttagggttaggtcttggagataaaaggattgtgctccacccatggcctggaatgtgaccgtccctgttgagtaatgggccattccagtgggtctcctggagcctgatgggaggtggcgttgtcttcctggggttgagtcaaggcagagctctggcccatacctggttgtgctgcaggtcagccctgggactcgtgggctttgggccgaggggcagcccgcatcccgctggagattaccctatctctgagatcaagcgtcatagagggtgacctcctgagaagggaaggcccactgtcgagggacctttcctaggattttgttgctcaggctgcttggaatccattgtgtcacctccagggtgatggaggtttgggcccaagcaatggagagggcaccatgtgtctcctgattgttcaagtgtgtcggagatatgcggggtatggatggtggcccaccaaagaaagcatgtgactcaagctgtgatttccagtgcatgcttagagagggcgcctgtatgcgtgccccacatgcccggggtaggctatgcaactgccaggtctgcagtggcgcatggcatcttggccagccttcttggttggccatgacctggctaatgaccctggcctgtgcccagtgatcccagggaagccctggtgtcatgcagcggaggcctcttgggcagtggaggtgctcttaaagcctgcagcatggcacggcctgggcatttatcccaagcccaatgaactacctgccctgtccttccagggttcggtggcaggcagggccaagggtgccccgtgttggtgacaagtcagtatttcacatggctctcatcacatgtgtccgtggaagataagcaagtgtgaactggcacgtcctacctccttccctacatggaggtaactttggacacatgttctccacctctctcccagatggtgagaccggaggaagacttgcattgggcctgttgttcctgggccagtggccatcagcctgttgcccagcccctgatgcgctgaagctcgggcccttcctcgcgccctggtctcctgcactgagctgtggtgagcacatccgggtcctgctggatgcatgcacgaggtgattgatcccctcagttgggtcgatgatgagaaccttatattgttctgaagagaggtgatgacttaaaaatcatgctcaataggattacgctgaggcccagcctaggtgagaattttggaagaggatgctgggatcccgagatccctggcagggccactatattttgggctggagaacttgaggccctgaagggcatctcaggggggtccaaccctatctctgtgcccctccatgaggcagcccaggctccctgtgtgggcatggtgtccgggctctggttccctgggggtggggcatgttggtggctccttcctgagcctgctttctcccccatgtctttcagtgagctcttctgcccaggtgaggcccatggccttaagcggcataggtgagtgtatcctgttggggtcatgggccatgaatgaggcagcatggggccatttatggtcagccttcgggccactagggttttctcagggtgcgaccggggagggaatgtttctccagtagggtcacttccttgggaatctgaccctaggagcatgcatttcgtgaagccctgcaaaggtgatggtggtcccggcaggaaagggttccttcagcccaacatagagcagctcccagctgaaactcagcgggctggtcaggcctcgaggactgcccaggccacatgaggtgggcaacaggggctctggggcaacctgggggtcacgctggagttctccctctctggacagtggtgggtgattgggcccacgcagacaggccccggagattcaggactgcaccccatccatggccctgaatgggaccgaccctgttgagtaatgggccatctcagtggtacctccttgagcctggtagggggaggcactgtttcaatgcagttgaatcaaggctgagctctggctggtgcctggtggtgctgcaggcagccctgggggttgtggtctttgggacaaggggccagctcacgtccctctggggtctccccttccttgagattcagtggccgaaaggatgtcctcctgaggtgggaagtcctgctgtcgagggacctgttctgggaatttgccacacaggctgcttctgagccacggggtcacctccagggtggtagggtcttgatcccaaggaaaggagaggacaccatgtggtttcttattgaccaagtgggacctggctctgtgtgtgggaggtgtagggcaagatgaggacccaccagagaaagtacgtggccctggaggcccccaggctttgatttctggtgtgtgcttggagagggcaccagggtgggcacccaccatgcccagggtaggctctgcaatggccaggtctgcattggctcctggtgttagggccagactcgctggttggccatgagcaggttggttgccctcacccgtccccatagtcccagtgcggccctggggttgttcgggggagccggcccgagcagtggaggtgctgttggggcctgcagtagggcatcttgccccagcccagtgacccaccttccctgtctttccaaggtttggtggccagcagggccaatggtgccctgtgtctgtgatgagtcagtgttcttcatggattccatcacatgggtatcccctacccacattcccctcgctcatatgtgaggccctggttggacacatgtccttctcctgtcaccaccccagatggtgagcctggaggaagacttgtattgggaccctacaggccccaggccagtgtctgtcagcctggtgctcatcccccagtgcgctgaagctcagaccctccctggcaccctggtctcctgcactgagctgtggtgagcacatccaggttctgctggatgcatgcatggggagggccttgattgggtcaatgatgagaaccttatattgtcctgaagagaggtgatgacttaaaaatcatgctcaataggattacgctgaggcccaggctaggtgagaattttggaagggagcgctgggatgccaagatccccggcagggccactagccactgtattttatactgaagaacttgaggccccaaagggcatctcaggggtcctagccctgtctctgtgcccctccgtgaggcagcccaggctccctgtgttgacttggtgtccaggctctgcttcctggggatagggcatgttggcagctccttcctgagcccacgttctcccctgtgtcttctattgagctcttctgcccaggtggggcccatgcccttaagcagtataggtgagtgtatcctgttgcggtcatgggccataaatgaggcagtgtggggtcatcgagggtcagccttcaggccactagcgttttctccaggtgcccccggggagggaacattgctccagtagggtcacttccttgggaatctgaccctaggagcacgcatttcctgaagccctgcaaaggtgatggtggtccaggcaggaaagcgttccttcagcccaacatacagcagctcccagctgaaatttggtgggctcgtcaggccttgaggactgcccaggcttcatgatgggggacacagaagctctggggctccctggggctcacactggagttctccctccctgaagagtggtgggtgattgggcccacagtcaggtggcggagattcaaggaatgcccccacccctggccctgaatgggaccaactctgttgagtaatgggccatcttaatggcgcctccttgagcctgttgggggtgggttgctgtttcaataaggttgagtcaaagctgagctctgactgggcgcctggtggtactgcaggccggcccttccttgggccaagggggcagcttgtgtcccgctggtgtcatcccttccttgaggtccagtggtggaaagggtagcctcctatggtgggaaggcctgctgctcagggacctgtcctggaaatttgccatccaggctgcttctgagccatggggtcacctccagggtagtggggtcttgagtccaagaaaaggagaggacaccatgtggttcctgattggccaaggctccttggttggccaggagcaggttggttgccctggcccatgccccatggtcctggtgtggccctggggttgttcaggggagctggcccaggccgtgaaggtgctctcagggcctgcagtagagtgcagcccaggcatcttgccccagcccagtgacccacttaccctgtctttctaaggtttggtggccaggagggccaatggtgccttgtgcccatgttgggtcagtgttctgcatggatccccatcatatgggtattccctacccaccctccctgcactgatatgtgaggccctggttggacacatgtcctcctcctgtcccttcagatggtgagtctggaggaagacttgtgttggacccccacaggccccaggccagtgtccatcagcctggtgctaatcccccagtgctctggagtttggaccctccctggcaccctggtctcctgcactgagctgtggtgagcacatggatgcatgcttggggtgggggttgcccttggttgggtcaatgatgagaaccttatattgtcctgaagagcggtgatgacttaaaaatcatgctcaataggattacgctgaggcccagcctaggtgagaattttggaagaggacactgggctccccggaatggccactgtattttgcgctggacacctgcaggccctgagggccatctggaaggtccaaccctgtctctctgctcctccaggaggcagcccaggctccctgagggggcttggtgtcgggctcctgttccccggggttggggccggttggtggctccttcctgagcccccattctccccttgtgtctttcagtgagctcttccacccgggcgggcccccggcattgactggcataggtgagtggatcctgcttgtgtcatgggccatgaaccggtccatgtggggtcaccaagggtcagcctttgggataagagggtttcctcagggaaccaacctgaattcccatcagagaggtatgggttctccaggagggccgcttttttgggaattggacccaaggaggataacttccctgatctctgcaggagtgacggtggtccaggcaggaaagagttccttcagccccacccagcgcagcgttctgttgagactcagtgctcaggtcaggcctggaggatttctcaggccatctgagggggttagaggggagctctttgtccatggagtgtggtgcttgaatctgcccttggggttgggtcatggagattcaaggatggtgcctcacccatggccctgattggaattgtccattgagaaatacgccattccagtgggcctcctggagcctgatggggggtggtgtttttttccctggggttgagtcgttgatggggactcaccatagaaagcatgtggctctggaggcccccaggctttgatttccagtgcctgcttggagtgggcaccagggccggcacccaccatgcccaagggcaggctctgcgactgccaggtctgcattggctcctggcatcaggaccagcctccttggttggccatcagctgcttggttgccctggcccatgccccgtggtcctggtgtggccctggggtggttgagtggagctggcccaggcagtggaggtgctcttggggcctgcagtagggtgcagcccaggcatcttgcctgatcccagtgacctgcttgccctgtctttccaggattttgtggcagggagggccaagggtgccctgcatccgtgatgggtcagtgttccacgtggatcccattacgtgggtccatagaggatgagcatgcgtgagccagcgcccccttcccacttcttctcatggagctgtgaggccctgtgtggacagctgtcttcctcttgtcccaccaggtggtgagcccggaggaggacttgcgttcggcccgctggtcccagtgtgtccggaattggtgggttcttggtctcactgacttcaagaatgaagctgcggaccctcgctgtgagtgttacagctcttaaggtggcatgtctggagtttgttccttctgatgttcggatgtgttcggagtttcttccttctggtgggtttgtggtctcgctggcttcaggagtgaagctgcagaccttcgcggtgagtgttacagctcataaaagcagtgtggacccaaagagtgagcagtagcaagatttattgcaaagagtgaaagaacaaagcttccacagtttggaaggggacccaagtgggttgccactgctggctggggcagcctgcttttattctcttatctggccccacacacatcctgctgattggtagagctgagtgatctgttttgacagggcgctgattggtgcgtttacaatccctgagctagacacaaaggttctccatgtccccactagattagctagatacagagtgttgacacaaaggttctccaagtccccaccggagtagctagatacagagtgtctattggtgcattcacaaaccctgagcttgacacagagtgctgattggtgtgtttgcaaaccttgagccagatacagagcgcggattggtgtatttacagtccctgagctagacataaaggttctccaaggccccaccagagaagctagatacagagtgtcgattggtgcattcacaaaccctgagctagacacagggtgctgattggtgtgtttacaaaccttgagctagatacagagtgccgattggtgtatttacaatccctgagctagacataaaggttctccaaggccccaccagactcaggagcccagctgtcttcacccagtggatcccgcactggggctgcaggtggagctgcctgccagtcctgcgccatgcgcccgcactcctcagcccttgtgtggttgatgggactgggcaccgtggagcagggggcggcactcgtcggggaggctctggctgcacaggagcccatggagggggtgggaggctcaggcatggcaggctgcaggtcccgagccctgccccgagggaaggcagctaaggcccggtgagaaatcaagtgcagcgccggtgggctggcactgctgggggacccagtataccctctgcagctgctggcccgggtgctaagcccctcattgcctggggccggcagggccggcccgctgctccgagtgtggggcccgccaagcccacacccacccggaactccagctggcccacaagcgccccgcgcagccccggttcccacttgcgcctctccctccacacctccctgcaagctgagggagcaggctccggccttggccagcccagaaaggggctcccacagtgcagcagtgggctgaagggctcctcaagtgccaccaaagtgggagcccaggcagaggaggcgccaagagcaagtgagggctgtgaggactgccagcacgctgtcacctttcatcaggacagtgtctgtcagccaggtgcacagcccttggtgtgctggagcttgggcttttcttggcagcctggtgtcctgcattgagcggtggtgagcttgtccaggtcccgctggttacctgcacggtgacgggggtgccctcggttaggttgatgatgagaaccttattttgtctcgaggagaggttatgtgatgggtgttgtggcagctctttgtatttcattttcttcagtgctttttgtgtgttctctttgtattttttaccgctttgtgtattttactttcacaaaggcagcagcaaatgttttattggtggtggtatttttcatttttatttacttcctaatttgatagtgttttagttggaatacacagtctcattgtagttgttcagaaatatgctttttttctgtacattatatgattgtgcataatttttgccagttttttttttaattggggactacagttgaatgcactgcctatctcctactttactgaaacagattgtatggaaatctaaagacgagaaagtagacaagcacagcagaggacatttattttgatataaccacagaaattcattgatatgaccttatcatattgatggtttttcaaagaaatataaaatctttcgataatggattgtctcagttgcgtttctccttatatcatgttttgccttcaatacaaattgcaatgcttagaaatttaaagaacaccttctgaagtggaagatctagctaaagaattagattggtattggctgaaatgttgcagtaatcacatgatagggttaatacaacatgagttacatgctgagtgctctaaggtagaaagtaggtaacaaggaataacaggtaggtaatgtaagtcgggagaaggaaactctaggacagaatcattagaaaaggcttgacgtcaacagcagtgtatagaatttacagtgtatagaatttacagtgcatagaatttacaataagtgcctttttttgtgctcatcaatgctcttgcttatattgtaggaggagttagttcccttgaagaaatatcaatacaaatttccaaattgcaatgcagagggaaaaaagaatgagaaagtaaaaaatatccaagaactctggaagcatttcaaaaagtgtaaaaatgcatagtgacaatgtcaggagaataaggagataaaggaaaagaaatatttgacacaacaatgacttgagcactttctaaaattaatgatggacagaaacccacatgttcaggaagctcagagagcactctgcagaataaaaatattttacaaatcgacacctttgcatttcatatttaaagtccagaaaatcatagactaagggaaaagcttgataggagcaataggaagaaaaccatcttacctatggagcaacaagaataaaaattgctttgaaattatcttcagaatccatgaaagcaagaagtgagtcagggtgaaatatttagtgttaaaagtaagaaacaaaaaaaagtaccaactttgaattttctgctcatcaaaattattcttcaaaagtgaaggagaaatactctctgagaccaacaaaaattgctagaacttcttgccactacaccaaccttttaataaacgtaacaagaaattcttcagaaaggataaaaatgacataggtcggaaaatctaatttacataaagaaatgaaaagcattggagaagaaatatatgaagaaaaattaaatatatatgtattttttgattcataattgatctttcaacaatttgttcaaaataataacaagattatatttggtgattataggttatggaaaagtgaaatgaatgacagcaatattataagtcatccggttccaagatggccgaataggaacagctccagtttacagctcccagtgtgagtgacgcagaagacagttgatttctgcatttccaactgacgtaccaggttcatctcactggggcttgttggacagtgggtgcagcccatggagtgtaagccgaagcaggacgaggcatcacctcacctgggaagtgcaagaggtcagggaattccctttcctagccaagggaagcgtgacagatggtacctggaaaattgggacactcccaccctaatactgtgcttttccaactgtcttagcaaacggcacaccaggagattatatcccgtgcctggcttggagggtcccacatccacggagccttgctcactgctagcacagtagtctgagatcaaactgcaaggcagcagtgaggctgggggaggggcatccaccattgctgaggcttgagtaggtaaacaaagcggctgggaagctcgaactgggtggagcccaccacagctcaaggaggcctgcctgcttccgtagactccacctctaggggcagggcatagcagaacaaaaggcaacagaaacttctgcagacttaaacatccctgacagctttgaagagagtagtggttctcccagtacagagtttcagatctgagaacagacaggctgcctccttaaatgggtccctgacccccaagtagcctaactgagagacacctcccagtaggggctgactgatacctcatacagctgggtgcccctctgagacgaagcttccagaggaaggatcaggcagcaacatttgccgttctgcaatatttgctgttttgcagcctccactggtgatacccaagcaaacagggtctggagtggacttccagcaaactccaacagacctgcagctgaggatcctgactgttagaaggaaaactaacaaagagaaaggacatccacaccaaaaccccatctgtacgtcaccatcatcaaagaccaaaggtagatgaaaccacaaagatggggagaaaccagagcagaaaaactgaaaattctaaaaatcagagcacctcttctcctccaaaggaatgcagctccctgccagcaatggaacaaagctggacggagaatgactttgacgagctgacagaagtaggcttcagatgatcgctaataacaaacttctctgagctaaaggatgaggttcaaacccatcgcaaagaagctaaaaaccttgaaaaaagattagatgagtggctaactagaataaacagcatagagaagaccttaaatgacctgatggagctgaaaccatggcacaagaactacgtcacacatgcacaagcttcagtagccgatttgatcaagtggaagaaagggtatcagtgattcaagatcaaatgaatgaaatgaagcaagaagagaagtttagagaaaaaagagtaaaaagaaacaaagcctaaaaaagtaaaaaagtaaaacaaagtaaaaaagaaacatgggactatgtgaaaacaccaaatctacgtctgattggtgtacttgaaagtgatggggagaatggaaccaagttggaaaacactctgcaggatattatccaggagaactcccccaacctaggaaggcaagccaacattcaagttcagaaaatacagagaatgccacaaagatactccttgagaagcgtaactccaagacacataattgacagatacaccaaagttgaaatgaaggaaaaaatattaagggaagccagagagaaaggtcaagttacccacaaagggaagcccatcaaactaacagcaaatctctcagcagaaactctacaagccagaagagagtgggggccaatattcaacattcttaaatgaaagaattttcaacccagaatttcatatccagccaaactaagcttcataattgaaggagaaataaaatactttacagacaagtaaatgctgagagattttgtcaccaccaggcctgccctacaagagctcctgaaggaagcactaagcatggaaaggaacaaccagtaccagccactgcaaaaacatgccaaattgtaaagatcactgatgctaggaagaaactgcgtcaactaacgagcaaaataaccagctaacatcacaatgacaggatcacattcacacataacaatattaaccttaaatgtaaatgggctaaattctccaattaaaagacacagactggcaaattggataaagagtcaagacccatcagtgtgctgtattcaggagacccatctcatgtgcagagacacacataggctccaaataaagggatggaggaagatctaccaagcaaatggaaaacaaaaaaaagcaggggttgcaatcctagtctctgatgaaacagactttaaaccaacaaagatcaaaagagacaaagaaggccattatgtaatagtaaaggggtcaattcaacaacaagagctaactatcctaaatatacatgcacccaatacaggagcacccagattcataaagtaagtccttacagacctacaaagagacttagactcccacacaataataatgggagactttaacaccccactgtcaacattagacagatcaacaagacagaaagttaacaaggatatccaggaattgaactcagctctacaccaagcagacctaatagacatctacagaactctccaccccaaatcaacagaatgtacattcttctcagcaccacatcgcacttattccaaaattgaccacatagttggaagtaaagcactcctcagcgaatgtaaaagaatagaaattataacaaactgtctctcagaccacagtgcaatcaaactagaactcaggattaagaaactcactcaaaaccactcaactacatggaaactgaaaaatctgctcctgaatgactactgggtacataatgaaatgaaggcagaaataaagatgttctttgaaaccaatgagaacaaagacacaacataccagaatctctgggacatatttaaagcagtgtgtagagagaaatttatagcactaaatgcccacaagagaaagcaggaaagatctaaaattgacaccctaacatcacaattaaaagaactagggaagcaagagccaacattttcaaaagctagcagaaggcaggaaataactaagattggagcagaactgaaggagatagagacacaaaaaacccttcaaaaaatcaatgaatccaggaactggttttttgaaaagataaacaaaattgatagaccactagcaagactaataaagaagaaaagagagaagaatccaatagatgcaataaaaaatgataaaggggatatcaccaccaatcccacagaaatacaaactaccatcagagaatactataaacatctctatgcaaataaactagaaaatctagaagaaatggataaattcctggacacatacaccctcccaagactaaaccaggaagaaggtgaatctctgaatagaccaataacaggctctgaaattgaggcaataattaatagcctaccaaccaaagaaagtccaggaccagagggattcacagctgaattctgccagaggtacaaagaggagctggtaccatgccttccgaaactattccagtcagtagaaaaatagggaatcctctctaactcattttataaggccagcatcatcctgataccaaagcctggcagagacacaacaaaaaagagaattttagaccaatatccctgatgaacatcgatgcaaaaatcttcaataaaatactggcaaaccgaatccagcaacacatcaaaagctaatccaccacgatcaagttggcttcatccctgggatgcaaggctggttcaacatacacaaatcaataaacataatccatcatataaacagaaccaaagacaaaaaccacatgattatctcaacagatgcagaaaaggcctcgacaaaattcaacagcgcttcatgctaaaaactctcactaaactaggtgttgatgggacgtatctcaaaataataagagctgtttatgacaaacccacagccaatgtcatactgaatgggcaaaaactggaagcattccctttgaaaactggcacaagacaggaatgccctctctcaccgctcctattcaacttagtgttggaagttctggccagggcaatcaggcaggagaaagaaataaagggtattcaattaggaaaagaggaagtcaaattgtccctgtttgcagatgacatgattgtatatttagaaaaccccatcgtctcagcccaaaatctccttaagctgataagcaacttcagcaaagtctcagaatacaaaatcaatgtgcaaaaatcacaagcattcctatacaccaataacagacaaacagagagtgaaatcatgagtgaactcccattcacaattgcttcaaagaataaaatacctaggaatccaacttacaagggatgtgaaggacctcttcaaggagaactacaaaccactgctcaacgaaataaaagaggacacaaacaaatggaagaacattccatgctcatggataggaagaatcagtatcgtgaaaatggccatactgcccaaggtaatttatagattcaatgccatccccatcaagctaccaatgactttcttcacagaattggaaaaaactactttaaagttcatatggaaccgaaaaagagcctgcattgccaagtcaatcctaagccaaaaggacaaagctggaggcatcacactacctgacttcaaactatactacgaggctacagtaaccaaaacagcatggtactggtaccaaaacagagatatagaccagtggaacagaacagacccctcagaaataataccacatgtctacaaccatctgatctttgacaaacctgacaaaaataagaaatggggaaaggattccctatttaataaatggtgctgagaaaactggctagccatatgtaaaaagctgaaactggatcccttccttacaccttatacaaaaattaattcaagatggattaaagacctaaatgttagacctaaaaccataaaaaccctagaagaaaacctaggcaataccattcaggacataggcatgggcaaggacttcatgactaaaacaccaaaagcaatggcaacaaaagccaaaataaacaaatgggatctaattaaactaaagagtttctacacagcaaaagaaactaccatcagagtgaacaggcaacctacagaatgggagaaaatttttacaatctactcatctgacaaagggctgatatccagaatctagaaagaagttaaacaaatttacaagaaaaaaatcaaccccatcaacaagtgggcaaaggatatgaacagacacttctcaaaagaagacatttatgcagccaaagacacatgaaaaaatgctcatcatcactggccatcagagaaatgcgaatcaaagccacaatgagatcccatctcacaccagttagaatggcaatcattaaaaagtcaggaaacaacaggtgctggacaggatgtggagaaataggaatacttttacactgttggtgggatggtaaactagttccaccattgtagaagacagtgtggcaattcctcaaggatctagaactagaaataccatttgtcccagccatcccattactgggtacatacccaaaggattatatatcatgctactataaagacacatgcacatgtatgttcattgtggcactattcacagtagcaaagacttggaaccaactcaaatgtccatcaacgatagactggattaagaaaatgtggcacatatacaccatggaatactttgcagccataaaaatggatgagttcaagtcttttgtagggacatggatgaagctggaaaccatcattctcagcaaactatcgcaaggacaaaaaaccaaacactgcatgttctcactcataggtgggaattgaacggtgagaacacttggacacagggtggggaacatcacacacgagtggctgccgtggggtggggggaggggggagggatagcattaggagatatacctaatgtaaatgacgagttaacgggtgcagcacaccaacatggcacatgtatacatatgtaacaaacctgcacgttttgcacatgtaccctagaacttaaagtatgaaatatatatatatatatatatatatagtcatgagggagagaaaatactcttagttacttggactaacccacgaagtaggacagtataatttgaaaaaggacttggattagttgtaaacgtataatgtaatatccagcacagccactaaaaatgattttgaaaaaagcagtataatcaatatactaacagaagaaaaagcagaatcaggccagacatggtgactcatgtctgtaatcccagcactttgggatgctgaggcaggaagatcacttgagccccggagttcaagtccagcctggcaacgaataagagcccatctctaccctccaccccccccaaaaaaaaaaagaaaaagaaaaagaggccgggcacggtggcttactcctgtaatcccagcactttgggaggccgaggtgggtggatcgcgaggtcaggagatcaagaccatcctgcctaacacggtgaaaccccgtctctactaaaaatacaaaaaaaaaaaaaaaatagctgggcatggtggcgggcgcctgtagtcccagctactcaggaggctgaggcaggagaatggtgtgaacctgggaggcagagcttgcagtgagccgagattgcgccactgcactccagcctgggagacagccgcaagattctgtctcaaaaaaacaacaacaacaacaaaaaaaaacaaaaacaaaaacaaagaaaacgaaaagaaaaagcagaatctttttttttttttttttttttttttttttgagatggagttttggtcttgttgcccgggctggagtgcaatggcacgatttcagctcaccacaacctccacctcccaggttcaagcaattctccgggctcagcctcccgaatagctgggattacaggtgtgcaccaccatgcctggctaattttttgtatgaaaaagcagaatcttatacaatgctcaattaaaatcagggagaggagaaaaagagtagaataccaaaaaagtaacaaattacaaggttgatataaatagaaaacaatcacaaatactgagtatactaatctaagtatatcaataatcactttaaacatcgcttaaaagacagagattgtcagtggattaagaacaagacccaaatatatgttgtctatgagaaatgcactttaaatagctgggcatggtggtgtgcacctgcagtccttaggaggccaaggcggagtgtcacctgagcccaggattttgggactacagtgagctatgatcatgccactgcactctagcctggttgacagaataagacctcatctctatagaaaaaagtaagtaaatctactttataaaggcacaaatatattcacagtaaaggaatagagaaagatatcccatgctaacattaatcaaaataaagtgaaatagccatattaatttcagacacaaccgactttagaacaaggaatattatcagagatcaaaagggacattccttaatgataaagggatcagttttctaagaagacataacaatccttaatgtgtacgcactgaacagcagatcatcaaagtacatgaagctaaatctgatagaactgcatagagaaatagataaattcactcttagagttggaggcattggcatccctctatcagaaatggacaggtttagcaagcagaaaatcagtaagggcataacatgatcaatcatgatcaaaaacttgattcagtcaactatatgtaactgacatctatggaccactttacccaacaacagcagatgacacattttctcacacacacatgaaacattcagcagaatagaccacattctgggctagaaaatgcacctcaacaaatttaaaagaatagaaatcatacaaagtatgttctcagactacaatggaatgaaagtaaacaaaaatcactaaaaaagatagctgaaaaacatgaaaatacttggaggttaaacaacagactgaaataactgaaggtcacagaagtctcaagataaatttttaaaatatttcaaactaaatggaattgaaagcacaacttatcaaaaatttaggaacgcaacaaaggcagtgcctactgggaaatttataccactgaatgtatgttaaaaagaacaaagatctaaataaataatccttcccattggaaagctagggggaaaattcaaattaaattcaaagtaagcaagtaaaagaaataataaaatatgaatacaattctgagtggcctgatatctgatttctggaagctgagttttatgtggctttagaagtttcatgttatgagtgtgaaatggcaagtgaccatggcgattgcttctgatatggccacctcaattacatagagaagggatgatcagtggcatcatcccagttctgcatgataccacaccagtgattctccaaagtcaagaaacctgtatatgttgtccttgtgtttggtgaatctgtggtctatagactacataatgggctatttctggggtactgaccattttgctccattaaggaaaaccatgcatgagccatataactatgggaaacaatgttttcctttttgacacctggcctactctcttcttaggtgagagcaaaggaagagcaccacttggcctgctgcacccagggcaatttataccatccagatatccagcactgaatatgtagcaactccaatccaccatagaacattaatctatctctgataagcatgctaatatctatgattctgcctttgtggggagatgactccatagattaaccccctggcttggggcaatatggagatgttatattgtcttcgacagggaagatgacataaaaattatgttcaataggattatgtggagacttaacataagtgacaaacctaagacaagaagttagaaatccttgtttcttttaggtgaataattttggagcttgagaaaaagacaccattgtggcgaacttgctttgccaaaccctgtgtatgcatttttgggtaaacaacacattttcatcctttaagcattgtttccattatttataattcctaatagtatgagacatttaggactcattccttggttcttcttctctcattgtatctttcattgtatctttcagtgctgcaagagatgcaatcatcccattaatgaaagcagagtgactgccttcgtcacacatacattcaaaatagatcactaggctagtgatgattctctcttaaggctattatgtttactcatttaaaaaatctggatctcagtatagattttcttctcagtgagtgactgacctatctgatatgatgctatgacaaaatctttactttttacctgaatttggtgggattgaaagttgagaacatattaatttattttctgtttcacttgattaataatgcccaatctaacatgcagtgttcacttgggtacatatatacaactacatcaaattttttcttgttttaccttaaaagtgttaagatattgtaatggtatggccagtttactcactggtaaacttttcataacagaaatatcatgccagtggacacaaatatgtaacatcagtaatttgctttcctcatgaaacagagaactgaataagttgatgggtaaactagtatctgaattataaaccccaaatatcatgtgacttcatcattttcagtataatgaaaatacaggctgtgaatgcttccagttggtcctgaaagggcctttgaggtgagtaggttcaccaaagcggcaacatatgtgtcccagtgggcattctactcctcagtaagtgacttgacattctttatggcttcctcatgattaaaacaagtctttttattgaaattttactgaaataatgatgaaacaatgtaatattcttttcatctacatataagagtagacatagattaacctctaccttttttttttttttttttgagacggagtctcgctctgttgcccaggctagagtacagtggtgcgatctcagctcattgcaacctctgcctcccaggttcaagcgattctcctgcctcagcctcctgagtagctgggattacaggcacgtgctaccattcctggctaatttttttgtaattttagtagagacatggtttcaccatgttggtcaggctgttcttgaactcctgaccttgtgatctgcccacctctgcctcccaaagtgctgggattacaggcttgagcccccgtgcctggccttcacctctacctattataatattttcatgttattccattttgtcatgtttgtgggtcatttgatgagggttcacaatatgaaaactgggcattttggccaagatgcatgtaaatgaatacaactccatgtgccctgataactgatttctagatcctgagatgcaagtggcttccagagtgtctgtattttatgaaagttcatatacagtaaaccatgctaattgttactgatacagcttccttgaatatataaagcgatgattaatgggatgttttgtttctgcagaaaaccactgaattgcttctccaaagccaagtgacctgtatgatttgtccttattatattttgtgaaccagtggactaaaacctttataatgggtcatttttttagtattgtcaatattgctcaattaacaaacatgactcatatacacaggtgagatgtagttctccctttgacatttgctctacatctgtcccttagatgatgatatggaagaaaagcactctttggcctgttgtgactgggacagttgacagcacccaggtgtcctttaatgaaaatgctcttgacaccaatgcatcctagcatcacagcttcaggaagccttctcaagtgtgcatggggagtactatgtctttcatcaataatgaaatcttctgatttggtgagaaataatgccttaaaattacactcaataggattatgctgaggctcagcctacctagatgaaaatgctgaaacagataatagtgacttcttatttcccttcaaggggaattttattttgaacttgaaataacaaaatctttatgggtaacttgtttgcccaactgtatcagtgcacctataaatgaacaaaaaattctcagcctataagctttgcttcagtgacctttaatttctaatagtaaggtatattcaggtctcattctttggctttttctcttattgtgtatttcagtaagacatgctgccaagagatgtgccattctattataaaagatcagtagcttcctttaccgacgtgtatattctatctagaacattgagctatggaagactcccacctaagggaattagttttacaccttcaggtaatctgaacttcaatatgagttttgctttatgatataatccttatgacaaaatctttactttttatctgaacttcatacaatcaatattgaagattttttaaattcactgttacctagtccaatatttaatatacatttggctgtagatacatgactagacaaaaattttttatattattattgtgggggctctaacagtgtttcactgttttgagttactgatgaactttctgtaactgtgagaccatggtaatggaagagaccgtggtaatggggaggagaatgtgaggatcagtatgtactttgcctataaaacttaaatatttagtaatttgatcaccaaattgatactcaaatttcagttcctatcatgtgtaaaccaaaaagtatctgagatttagaagtttatttagaagtggattttgccaaggttaagcacatgctcagaagaaataaacccaaaatcacagaaaccgtctggggtctatgtctttctccaaagatgattttgagggcttcagtgtttaaaggggaaaagtgggctggagggggaaaagggagggtatgataatccgtatgttccaagacaaaaggagcaggtaggggtatagtcaataatgtattcatctcatgctcagtaaatcagcactttacataagataaggtgaacatagagaagctacctgtggagatctttaacctttaatctgtagctatctgcttaagatcaaaaggaaattcttgcatgactcagctttcagcttattttttttttctcttggcgtagtaaattggggtcccaagtttattttcctttcacacatgtgaccccactattttcagaataatgaaagcacatgttagaaatgatgacacttattcctaatatggactttgaaatgactgggttcacaaatttagaatcatggatctcattataggtttttattttcaatgagtgactggcctacttgatggaattctttcaaaaaatgttcactttttactgagattatattaaaataatgttggaatgtgttcagtcatgtttaccatctctatagtatgatatatgataatatcgcagattactcagtgtcaaaaacctggcataccttgtccttatgatgttgatgagtcaatggtctagagccttagtaatatgtctttttgtggtagtacggaccgtatctgtccactaagaaatagcctgtgtaagccatatacacatgaacaatttatgtctgattttgaactatggtcccattcctatgcctgtagataaagactgctgagaagagcaccctctggtgttgtcacagaggcaagtgctaccgcacaggcatgctgcagtgaatttaactgatcctctgtccctgcaaccgttgtttaaggatgctattctggtaagggtttacaagacaacgtaaatatatgtataaagagtatcttcaggagacgtaataatgtaaaaatcatgctcaatagaattaagctgaggctcaaaatagtgccaatccttgcaagaaggtgtgagaagtcattagatttggggggtatgggttattccattttgaacttggtaggaagaaacccttgggggaatcttacatcatttgcctctacctacttctaaaggaacttttaaaattcttttatcttgtctttattcttaatactcatacattattagagagaatatcttggtttattttttcctcatggtgtgcttcagaatgttcatccagcaagaggtgtgtcattacacggattatatatatgagttctgtctttcgtaattaaaaaatttcaagtggaccatttgaatattaaacattggccttcaaaatgattacatttacctgttcatacaaaattagtgagcaatgatctattctttccaatgagtgactgatctaatgaggtcctcattaaaactccttttttttttttttttttttttgcctgaacgtactttgatttaaagatgtgacatttagtaattcattgcaatcaactctttagtgattgcacaaatagacaatccttttctattattttattttttggttgctgtgtatggtgttatgatgtttgtggatcattgaggcactactcacaactgaaagactttggcaattttagggaatggcttgagattcagctataggttacccttgattgaaattgaatacaatacaggtagtctgaaatctcatttccttatcctgagtctcactcaggtgtcattagattcattataaagaaatgcatacactatgtatgatgccagttgttactgatatgaagacgataagaagcttttatttctgcagggaaataatcccttaccaggtcatcaaaagacatgatacctatgtgcttggcccttactgtacacggggaatcagtggtctaccacagcttaagtaacgggtcatatttggagtatcacacatctcagtcttgtagaaattaggaacagcaattaggagtcatgcacatataagagatgtaatcccaccctttgactatagcctactcttgtcttttacagaaaagactgtggaggaagaaaaccctttaccctgttgttcagggagaaactgacaccactcaactgcctggcactgaaaatgtggcatccagtccactttaccatcagtgtttaaggaaaccatctctggtaagcatatttgatccaagtgtgcatatgcacatgagtgccatgggctgggtcaatgatgagatgttaccttgaagagaaatgatgacgtaaaaattaagttcagttggattacgctgaggcccagcctaggtaacaattgtgagacaagaagtttggatttcttagtttccttccattggggactttattttgggattctggcaatggaatcttattgcgaaacttgttttgcacgcttctatctgtgtgcttctaagtaaactataaattctgattctttaagtgctatttaagtttcctacaattcctaattttcttggatatttggcactaagacccttgctctttttctctcattggatgatttagtaagtcctactggcactattctattgagtggaggtgagaggctgcctttgctgactgaaaaatttcaaatagataattgaactagtgaagactgagctctataataattagatttattcattcagacaacatgaatatcacgatagggttttcttctcaatgattgactgacacatgtgatgcaatcctcatgagaaaatccttacttttgccctacgattgattgttttcagggttgagaaatatgatacattggaattttgctcaatgcgctacagttatcgtggtctaaatatacagacaaaattttctgtaatgttagtataatattttaacagtgctaggatatgttttgatcattaatgaatctttatgacttaagggtccttgcaattgggataaaaatgtgagtttcaataatatgtgtttgcccatgaaacttgaaattagataaattgatgagcaatctggtgcctgacttttctttctcaagtacctttggcttcgttttcattatgatgaaagtgtgtgctgtgaataatgccaatggtaaataagacctttatggacacttatatgaatgacagtcagggccgttccttcaggccacatgattatcgttatgcattcttcttctcaatgagtgactagcatacttgccaggatctacaagagggaaactttattttttactaaaattgcatcgatataatgttgacaagttttgtgattattggtatcatctctaagatgtgatgctcatttggtctaaatatagaagttaacatattaacttctaatttatatatgtcaggttgctatgtttttacaatgtttgtggtttattgatgatgactcacaacataaagactatggcattatggctacatgttctaattctgatatatacatatcccatcattcattaaattaaatacaattatgagtagtatgatgtctgttttctaaaatctgagtttcacctggctccagtatgatcattatatgatggagtgcaagcaacatgttaatgccaattgttattgatatggcttccttgaatatgtaaacaagactgatcaattgaaggtcttatttctgcattaaactacctgagatattctccaaattcaagagacctgtatagttagtctttattctgtttgatgaataaatggcctatagcctatctaatggatcagtttttccagtactaatcatatctcttcattaagaaatagcatgcataagccatacatacaggaggtaatatttgtcatcttgatctactgtcttatcctcctccccttagataaggatgactgaggaagagtactctttggcttgttgacaccagcacagctgacacacccagatatctgtttggtctcctgtgaactttcaaccaggatttaaggatgccactctggtaggtattttcagacaaagtgaatatgtgattgtagagttccatggcttgtttcaacaataagaccttatgttgtcttgaggacatgagatgacatgaaaactagactggctggtccttatcttttctggggtattctagtttgagcttaagataaagaaatatatttgggatatagtttctctcacctgtttctattagcttctagaagaccacttatcaattctttcctcctgatttagtggaaaacattttggcagttcctcaaaaagttaaagataaaattaccatgtaacccaacaattctgctcctaagtacacactcaaaagaattgaatacaaatgttcaaatgaatacatacacatgaatgttcatagcagcactattcactggctggagttccagaccagcctggccaacgtggcaagaccctgtctctactaaaaatagaaaaattagctgggcatggttgctcacgcttgtagtctcagctactcaggaggctgaggcacaagaatcacttgaacccaggaggcagaggctgcagtgagctgagatcacaccattgcactccagcatgggtgacaagtgagattctgtctcaaaaaaaaaaaagtgaaggtatgatgacaatgtcacacaaaatagtgaataccaataaaaagatagaaattattaaaaagaaccaaatgaaaattctggagttgaaaagtacaataactaaaatttaaaaatttattagaaaggctcaatagtagatttgaactgggagaagaaacaagaagtaaacttgaagatagaacaatagagattatgttcaaaagaacagaaagcataaagaataaagaaacaaagagagtctcagagaatgtggaacatcattaagcataccagcatacacatatgggagtaccagacaggcaggggagatacaaaggatcagaaaaaaatatttgaaggaataatggctgaaacctcccatatttgtggaaaacaataactgacatatccaggaagctcaatgaattccaatgaataaatgcaaagattgacaaatggaaacatcacagtaagatatctgaaagtcaaaaacaagaagaaagtcttgaaagcagtgtgagaaaaatgatttgttacttacaagggaaccccaggaagattaacagctgacttcagcagaagcaatggaggccagaagcaaaggcataacatattaaaaatgctcaaagaaaaaagaacctgtcacctaagaattctgtacctggcaaagctgtctttcaaaaatgaaggcaaaataaagacttcctcaattaaaaaaaaaaaagttggagaatctactgctctcaaaacccccttaaaagagttctctaaatacttaaagaagttattcaagctgaaagcaagtgagcctaggtagttattcaaatcaacaactacaaagcaaatgcttgtaaaggtaattatataaatataaaagacagtagaaatgtaatttttctctgaagtgattttaaaataaattctataaaataatatgtatataatgtattttggggtctataacatataaaagtgtaatatatttgccaaagaagataggtggatgcaaagcaatacaagactaaggaaatgactacagatggtagattaatatttattataatgtctttcttggcttatagcatcaataaatgtaatatgtataataataccacaaaagatggcaaaaagggaatagagctatataggtgtaacatttctgtataagactgaaattaagctagtgtaaattagaaacttatttgggtgagttaagatatatgcagtaaaccctagagcaaccactgaaaaaattcaaaacatatagtgaaaaaaattattaaggaagtttaaatgctacattataaaataattacttaatgaaaaagaagtaaagaggaatagaggaacaaaaacacatgagacacagaggagaagaagaatgacataataaactcaactaaataataaaattacatgtgaatacagtaaatatgtaaattaaaaggcagagattcccaggctggataaaatctccaggtttaatatccctttgccccaaataaactccagctttttttcctatgatgtatttgatcattgtgctggtttacaaaagatttctaacctttctaaaatctttaaaatcagcggcgaagtgttctatctcatttcacccatatatatcagagactcaaatcctgaaaaataccaagttgacctgcccattcttgagttctgctgaatggtgtgttcccagatcactatggatattgctgtttacttgaccaattacttttagtcaacaagatttgaacaatgcttttgattcacacagcgtgagacctagacttccctcatattgaaataggagcattagcatcctggattcctgcaccggcttttgaaccttatgtttcctgcaccccaagaagccatgttatctggacattgtcctctctgtgatgggaaagaagagttttttcaacaaatgttgctaggacaactggatatctagatacaaaagatactgcatttatgttaccagttttctgtgtcagtccattttgctctgatgtaacagaatactgcagactgggtatttgtaatgagtggaaacttattggctcacatttctggaggctggaaagatcaaggggctggcatatgataagggccttctcactctgtcatcctatggtagaagggcaaagagagggtatggatgggacaaatatcttcttttataggaacccacccctgaaataacagcattaatccattgatgagggcagagctctcacagcctaatcaccttttttttttttttttgagacggagtctcgctctttcgcccaggcgagagtgcagtggtgctatctcggctcactgcaggctccgcctcccgggttcacgccattctcctgcctcagcctcccgagtagctgggactataggcgcccgccacggcggccggctaattttttgtatttttagtagagacggggtttcaccgtgttagccaggatggtctcattctcctgacctcgcgatccgcccgccttggcctcccaaagccctgggatcacaggcgtgagccaccgcgcccggccgcctaatcaccttttaaatgttgctttattaaacactgttgcattgagggttacgtttccaagacaggcttttgaagtgaaatgaaaaatttgaccattcccaattatagtttgaaatttcaatgctcctttcttagtatgtgattgaacatggataagataatcagtaacggtggatgtaagaacactattaaccaacttgactccactgtcatatgtagaacacaacacccaacaatagcagaatgcacattatattcaagtgctcataaagcattattttgtatatatgtattttctcccttttttgataaagttagctagtagagtgcctatgtagttaatattttttaaaaaccacaggcttctcaattattaattacatctatggtttttaaaatattatcttcattaatttctgctttgatccttattcctttctttcttgtactttcttttatttttgttcttttttagtgttttaagatgaaaattgaattgtttcattcatctttttcattttttaaaataaaaacatttagtgcaatgaattttcctctagaactgcctttaaatgcatattacagattctcatatgttgtatattttaaaataatatgtaaatatatatttgcatagaaaaacatatttacatacaaaatatgtatttacatatttaaacatatgtattttctgtttatatttttccttttactcaggagttaataggatatttttaaaatttcttggtgaaagcgcctttatcttattgttagtaaagtctatgtttttgcattgtgatcagatagtgcagtttttaatatttcttgagttactaatttttctttccaacctaatatataatcagttttttgtgactatgccatgggcacttaagaacaacacagatcttctattatctgtcaagtttaatatgtagccataaaatctaccttatttttatgttgctatttttgcccacttgatctgtctttttctgataatggtgtattatagttttctattatgggatcatctatgtcttgtctccttacatctcatacatctcatgcagttttttattcataaaggtggttattatgttatttggtatataagtctccataagggtcaaatcttcatgtgtattatatcttttagcataaaaaaagtgtccttctttgccttgattaacatggtgggacttgaatacattgtgtgatataagaattactacgcttgcatgcgattggcatgaaaaaaaaaaagattactcctatctctttttgttttcatgtgcctgatatactttcgcccatccctttattttcagtcttttagaatccatttgttttagattcatctctcatagaaaacatattatgttttattttgtgagcccactgaaaatatttttcttctagtaggtgtgtggagtccactcacgtgtgtgtgtgtgtgtgtgtgtgtgtgtgtgtagctatgactgatatttattgtgtttgtattttctttatatttgctacgctcttttgtcacggtgtagtctttgcttgcctatttattcatacttaggagagtttttgtttttgttggagtgtttacttttgtacctctcttaattctgttagttctgtgttttcctagttaatcttttacttctgatttatcagtttgggggatgttcttcagcactcccctattctcatgcaaagtgctttcggttttcctctttttttttttttcctcctcctgtgtttagttgtcttatttctactttgtcacaatattagtgacatttgtatgctagtcttctaccctggatagggaatatacacctgtcagatggaaggaatatcatgttgtatgctgctgtcaaatagatcctaacatactttaataatcttttaaatgatataatccaagttcatagttaactcctgactttttatttctatcatattcagtagatatatcagcattgacagccatcccactgcaatatcacttcacattttgcttagaccaaagggttctgagaagcttctggagctgttgtgaaagccagtttcattaaagtcaagtcagacatccacctgtgctgttttctgctataagctgaatgcaggggatacaatgttaggagcatcagtgtggtatgaggaatgtttacttattggtagtagacttgtctggatcaaggataagtacaagtatctgagatgctgaggtgtggctgaatgaatggccatctgttctattgcaacaggataaataacacattcggagcaggcctaactggtgaactcctcaattatctcacaatagcactatcacgtgtctttcatttttcacagcacagtgtattttcataaaatctttattggtagaccacaactttagcatttcccattcaagatacaactactgtgtcacttggatagcttggtagagaggaaattggctattttcagagtaaagaattcaaggaggaaacagattataaatgaaatgacaaaggtgatgagatcaagcaatgctgacgtttgtagcaaggagtagagggctgagatgcctgtatgataagaaattataatggaaccaatcttgtgctttattttttattaatttggagcattctctgatctgatttattttctatgtgatattttgctgcaggttaaaagctgaaacaacttcaaggaaacttcagggaaaagaggtgagcagccactttggtacttttgaaattctttgttctgtgggcaatgatgtcagaatgtcaaagactgtgagttcattatttcagaggcttaaaggagattattcttttggtagatatatttccccatgggtgtccctaccttgttcaaggattccttattattgtttcttctctttgtttaaatctctttttgagatgacctaaacaactgtggagaatcattgatatatttccttttttcactgttcatgttgggtgaaaataatcttgtagtgaaattcacatgttctaaatattgtttttttacatctttatctggcacattcataacatagatgtttctatacatattagtactgtaatcataccatatattattctgttaccccacttactccttaaacttttagttaattaaagagtttttataaagtcccccaatagattttttttttttgagacatagtctcactctgttgcccaggctggagtgcagtggcgtgattttggctcactgcaacctccccatcctgggttcaagcaattctcctgcctcagcctgccaagtagctgggattacaggtgcctgccaccacgcccgactaatttttgtattttcagtagtgacagggtttcaccatcttggccaggctggtcttgaactcctgacctcgtgatccacccgccttggcctctcagagtgctaggattacaggcttgagccactgcacccggccagattttaatctaattttattagaacaattcagtcatatgttttttcatgctatgtatatgagagttccattattcagatactaaacaaatgtctactgtacatttactgttctcactgatgatgcattagataaccatgcacaaaataagcctggctgtggaaacgcttatttgttgggagggtgcttgtttggatcgatgatgagaataattgtctgaggatgctgagggactcattccagatgtcaatctgaggtccagatgtgcggccctccaataggacaaataagactctcagagcctggctctatttggggatccctcagtgacaacatagtacccctgtgagcgtgccttttctatctcttcgaagagggcagtggcatcctgtcttatgagtcagtgtgcactttagtgtgcctagtgacccaagacttgctttaattgtagatagatacttacatataggaaatatttcttaagtaacaaatgaaaaactttagaagattgaattaagggtcaagcaactgtgatatgtctgaaaatctcattagtgttgtgctgaaagaaggaaatatggcatgcctctattaaataatgacagtggaaccaagtttattgctttgttatttttactgtggagtattttctaagattatttttgctttttttttctttcatgttttgctgagatagaaggcctggaatctgatcctccacttcagagaacaggggtgagtagctaagccattatcttttgaaattcatatgtcatgtgctctttgctaggtctttaggtcgttttgtacatcttttcagaagcttattggaggacattttcatgatatgtccttttcctcattgagaccctcaccatgtcacctacactattgaatccttatcatttctcttttaattttaactctcttttgcttttatggaaaaatgtagaatttaagagaatttttggcaatttcatattggatcaaaatgtattgtagtgaaatccaggtgtgccaaaatattaacagattttccccatctgtttaattattggggtttcagaatagagactccatggttcataatatctttgtggtcatactacattatatttctgcttctaatttaattattaaatattgacttgaattagtcttttcctcattgttgcaacaaggtaagttatataggaaattttcttctcttgatggcatgtctgagataatcatagatataagacacctggctggtttctagaatgcatgtaatttttatttcttgatctgtgtgttgagtacttgctgtgattgcatcatgcaaatacattgagctttacaattttagtgtatgcacttttctacatgtatattattcttcgatagaaagtaaaaaaaacttatcgaactagtcaaaatattggttaatacataaaaaaagtctcaagtagattgtgtattacatggtgcttgttgattgatgccctcataatagatcaagtgggttctctctttagcacagggctttttagcaaatcatgtcatgagtagttactcaagtatttttattttaacacatttatattttttctatgtatattcttaaattctcttatacttttttctctgttataaaaacatgctgaacaatctcaagtcttaaggattgcagtattgtccccacatattcatgtattttggtactcaattctttatactttctttgacagatcacttgaactggcacatgtctcttgttttgcagagagggaattaatgtgataccttcatgcttttctattctatgtgctacataattgaatatacaagcaaatatagttgttaagatttagtgtgattatttctacaccacatgcaaagaagtttctcatagatcttaatagaggcccacatgcattgtacagtttagaatttggggaaatattgatgaagttgggtaaagtataaagccaaaagtcagaacagtgaactccttgcttaaggatttccttggagattacttagtcaatacacaactgataaatttaagtgcttttcaccttttgagttctcgacatactaaagctaaaatgtgtttcaacttttaatcctgcttccctgattttcccttttttagtctgagatcaaagagtttcagccataaattactgccaagagtaatcacttcattttaagaaagcttaacaatatagaagaatataaaattatttatgacagatgtatttttaaccttttccccatgctttccagaggaaatatgtttaatcatctgccctatattagggaaaaactttctatgctaatacaagtatctatcaatccatttatctttctatataagatgtattgatcataaccaattaactttactgtaaatgagctttagatttgacattttggtagtaatatatgttgtacaatctcctgaggtcctataggtcttgaggtctctatgtcaaaaactatagatgtgccagtgtcctcagtgaatgtgaaggacaccacattttccttagccatttcttgttttcagaataatggttatcaacattttgctactgcaagataccatacatttataatcggaatatgccagtttttatgcactcatgcctctgtttctgtagagcattcccagaatgagtaatgcttgaaaattaggtccatgtgatttctttaatgagttatagtcaaatcatgaaatattcaggttaccattatttcagtaatgtattagaatgtcaaggtaaagttatctacattgtatatatacacacaacatagatataatttatacaacatctatatttatacaacagatatatatttatgtatatatttatacaacataaaatatattttattatttaaacataaaatatattttattatttaatatagattcttaagtgataaatatgtttaatattattaaaataggttaaaataggttatagttagtacagtgaaaattggcagcccttttacaaaacatatgccataactatagcatttatcactgacagtcataccaggatagtcttttatttccaatcacttaaatattcctaattgcaaaagaaatttgaagactaaaattcagaagttttgaaagagccattgcctgggtaaactatacaggtttcagttttatttataataattatgaggccaggcgcagtggctcacacctgtaatcccaacactttgggaggccgaggcgggtggatcacgaggtcaggagatcgagaccatcctggctaacacggtgaaaccccatctctactaaaaatacaaaaaattagccgggcgtggtggcgggcgcctgtagtcccagctactcgggaggctgaggcaggagaatggcgtgaacctggtaggcggagcttgcagtgagccgagatcgcgccactgccctccagcctgggagacagtgcgagactccgtctcaaaaaaaaaaattatgtatatatttataaattaatacttaataaattaataacttgtgataggcaatgcaaagatgacagtaaaaggacaaaattgattagattgataaagtcctgttaacatgaagaaattgaccaggataccatccacactataaagttagagaaatttatcaggacaattccctaaaatactcttctcaattttaacattgtaacaggaatttttaaaattttggtattatgtgtgtttccttccagataatttgaacagattcatatttggtatttttaaaagccatatctttgtccttagtgctggcaatgtattcttgagaatgaacaaataagagatacgtaaaagcataagagaaggtatcaggttgaagtagtcaatcagttatacagaacacaaagaattttatcttgtataatgtttatatagctttatagaagtgtgctgaaagggctataaaacatggacattattatctcattgaaaggtccaatacgtactgaaatacatgcttttattttgaaccaaccaccctataaacgttgtatggcttatttagatgagagcccaggttgtgtgtgtctgtgtgtgtgtgtgtgtgtgtgtgtgtgtgtgtgtgtgtgtgtgtacctgacagggaagcaagaacatcgagttgccaatgcactctgtctatggttagaatcatgctgaaaacatggctcccccagttctggaatgagcccacagatcaagcattccccaaagacatagcaggctcaaatccctgtgtacacaatattttatgattatcttatgtcagtactttcaaagtatacagtttgtgtgaagacaaatccaatgtcatttttcttggctagcctatatgtgtggtaaatccattatttacttacttgcttcctgaaaattacaattagattaacaaactgcagcaaagtgggcatgatgagatagagattgaagtgtaagcttatgttaatgatgcccttggtttggataaacacatctaagagaaaaatggaaaaacacacatggcagggaagccttgatagagccaaaatataggattgtatgtagtaatgcaatccatagatgagcatttggcagtaatattatttttcagatatggataaaaattgcttaggagagtaaagagagacaaagttgaaagcaggtttatagtaggtgttgttttagtgttgatccctttttgctccaataatcaaagtgataaatattgaaaattgattcatgcagcattacttactccattctaatttttatatatgtcaaaagtgccatctcccaaactgtgctatccccttcaggagaagagactctgctgaagtttataaggttgacatattgccagcttcaataatgtaaagatgaagtgtatactgaattcttaatgcaaataacaactctattggaaagtaacccagttatagaagtgctaatttgtcaggagctgccttaccaagatcatgatgagtacagttatctcaggattctgaaagattgttttccgatttcaactagtctagctgaatgttccttgatagaaagagaggacttttagaattggttcaatatgatgacctcctgaattatctcacatagcccgtttgtacatgcctttcttttctctcagaaaatggcactatcataatagctttcttacacagacttcaccttagggttttacattaagggaggggtctggtgtttcatttattttgaagtatttgttgttgattgtgtacagtgcttgagtaaaaaattgaatatagaaacatctagaatatttttttaaaggatcagtgtttataaagtgaattattagtgtcaataatgttgggaaagttttaagagaatataggaaacttgaacattacacaactacaatgggaccaaattgtggggtctcattatagttaatatttatgtatttttttccaattgatttgtgtgctttttttctgcatgtttttggcagatagaatggctataacaagtaacagcatgtcaggtaataaaaataagcagagccctattcctttaaaaatcttcactgatgggagggccataaaataagtcttaatacatttaaagaattaaattcatgtaaaccatgttaatttaattccacaatgatattgaattagaaataagaggaatatctcttgaacatctcctaaatgtttggaaatttaaattagcatttctgacctatttattggttaaaaaagatacaaagaaaggaaaattgaaaagtcttttgaactgaataaaaataaaaatatagaatctaaaactttatgggatactgacaaaacaggatatagggaataatttatagcactgaaatgcctatattagaaaagaaaaaaggttttaaatcagtaaatttgtattttaccttaagaaacttagaaaagaacaaattaacccagacttaagtaaaataaaggcactaataaagataagagcagaaatcaatgaaatataaaacaacaaaacacagagaaaaattgagaaaatttaaaaatagcctagtgagaagatattgataaacttgtaaccagaccaatttaagaaaaaaagtcaaaacacaaataccaatatttgaaaatgtaggagggcaaatcattacagattctatgaatactaaaatgataataaggaaaaattatttaaaaggggcatgtcagccaggcatggtggcttacccctgtaatcccagcactttggcaggccgaggtgggaggattgctagagctcaggcattcgagaccagcctgggcaacatgttgaaaccttgtctacacaaaaagtacaaaaattagctgggtgtggtgttgcacacttgtagtcccagtcacttgggaggctgaggcgagaggatcacttgagcccaggaggttgaggctgcagtgagccatgtttgtaccactgccctccagcctgggtgacaaagtaagaccctatgtaaaaaaaaaaaaatgtatgccaacatttttcaataacttaaatgaaatggaaaaattccttgaaagacacgaactacaaaaactcagtgaacaagtaaataacctgaatagccctgtatcaagtaaattgaatttgtagttaaaagccttccaacagagaaaacttcaggtacctatagcttcatatgaaatgaaaaaaaaaataccaatcctctacaagattccagaacatttaaaagaagggaatatttcccaacttattccatttggacagcaatacccaggtaagaaaaagagacacagaaatttaaaaagaagaatatacattattccttaggaacataaatgcaaagaaatctaatcaaaattttggcaaatgaaatgtagaaatactttatgaccaagtgagagttacccaaagaatttaaggttggttttatatgtaaagatcaaccaatataggaaaatcacttctggaaagtcagagtaagaaactccaaaaatctactcctccataaaaccaataacagccttgatagaaatagttgaaattaattttccaaaactttggaaattaaccaaaggcttacaaaattccagagaacattaattcaagaaaaatggctgaatcagtaagaacagccagctttgtggcattttaatatgaccccttcccatgcttttctccctagtgctgagatagtcttaaaaattagcaggatagcaaccactggagaagaaaggtttggaaatttcccaaaaagttccatccccatagaattatcactatttgacctctaaagcccaatctataggatttatattcatttggactgactcagagctcactcagtaaggaaatctcaatttcaaggtattggtcaaaaagaatccatggcaattgttgactatcacaactgcctgaagtcttggtaacagttgggataaacaagaagctgatcaaaaactgaaaactaaaatcttgggaatgagatatctacaggatgcttcaaaaagctttgatacattcctgtttatctagaaagctacatgcaggctgggtgcagtggctcacacctgtaatcccagcactttgggaggccgaggcgtgcggatcatgaggtcaggagtttgaggccagcctgaccaacatggtctctactaaaaacacaaaaattagccaggcgtggtggcgtgcatctgtaatcctagctactcaggaggctgagacaggagaatcgcttgaacccgggaggcggaggttgcagtgagccaagattgtgccactgcactccagcctgggcgacagagcaaggctctgtctcaaaaaaaaaaaaaaaaaaagccacatgcatgtaattgtttacctctggctttccttttatgctctgggcaagctaaggaagagttgtgaactacctaagtgctgaatgggaaccataacacacacacacacacacacacacacacacacagcaccttagtaaagggtgagaggcatgttagttagaagcattaaaggaaatctctttctagtcattatctgtgcactaacctaactgagcagagacttcagtatccacatactacagggcatataaactttacagaattagtccaggaaaatcatatctaaaaaaaaaaaaaagcagtaacaaaaataaactctgggaaaggggagaatatgatttaaagagttgccacattatacataatatgtctagtgttcaacaaaaaattacgagacatgcaaagaaatagaaaaatatggcacaaagaggataagatgaagtcagtgaaactatcctcgaggaagaccagatgttggtcttactagacacagacattgaaccagctattaaaaatacgtacacagaactaagaaaaacatgtcaaaagggttaaagaaaggtataaaaatagtgtcttaccaaatatagactaccaataaagagatagaaattataagaaaagacaacatgaaaaaatataaagcaaaaaaattagacaattgaaacaagagggcctctattcgcagatttgagcaggcagaagaaagaatcagtgaacttgaagatatgtcaactgagattatccagtctgagcaacaaaggtgggaaaaaatgaagaaaactgagcaacaaagaactgtagaacagcatctctcataccaatggatacataaactggagccctagaaggatgaaaaaaggagaaggaaagaaaacttcccaaattttaagaaaaacattaatttatatacccgagatgaccaataaaatccaattaagataatctcaaagagaccaacacctatacacatcatagtcagcgtgtcaaaagacaaacataaggagagaattcttgaagatagtaagaaaaaaattattcataacatacacaccatcctcaataagtctgacaattgacttctcactgtaaaccatgcaggctaaaaaggcaatgtacataaccaaagtgatgaaataaaaaccttcaaccaatcattctagatccaacaaaactattgttcaaaaagaagaaatgaagacattcctaaacaaaatctcagagaaatgttctctataagacttgtcctaatagaaatgctaaaggaactccttcggtctgaaatagaaaggcactggagagtaaatcaaatccacgagaagaaataaagagaaccagtataagtaactacatgtgtaagtttaaaacaaagtataaatttattttgtttgtaacatttgtcttttcctatttgatttaaaatataatctcaattataaacttgtgttgatggtattatataaagatgtaattttgggttatagcaccaaaatggcagaataggaattttctgtaggtgtttcccacataagtatcaattttgacaaccatccatgggcaagagtaccttgtgggagttcaggagttgacagtaaaacttcagcacaccagaggagtaaagaaatctaagaatagattcattggaaagggtataaacagtttcactttacctgcatcaccaacccccaaaagtggcacagctcagtaacaagagcccattatttcttccacagaggaaaaggagagtataataagtaagtgtccagtttctcaagacatacaggcccctgcccaagagatccactttattttcatctcacccagaatattgaggtgatcagcaaggtggagtggttgggagagggtaaaagcaggaaagagagatggggactcaaacagcagcccatacttggaactgccatagatcctaccagttacttcatggactccatcaggaacccacctataagccacaggggatgcatccctcccatcttgccaacaaaaccccgaatgctccaaatgcctcacccactctttggctggctcccaagtgcgctcctgtgaaaagcgagtgagtatctctgcagatggcttgcaagcacatgttgacagctggctccactctgtagaactggaaaaaagctcacatacatgagaatttcaggacactaccctaaaaaaaaaaatgagacttcagcacctggcctggctttatgcaacctagagaaggtgatatgatttggctctgtgtccccacgtaaatctcatgtcaaattgtaatccccacgtgttggacaagggacttggtgggaggtgattgaatcatgcgggtggacttccctcttgctgttcttgtgatagagttgttatgagatccagttatttgaaagtatgtagcatgtcccccttcactctcttgcactcctgctccaccttggtaagacttgcttgctacccctttgccttctgccatgattgtaagtttcctgaggcctcccagctatgcttcctgtatggcctgcagaactgaactgtgagccaattaaacctcttttcttcataaattatccagtcttaggtagttctttatagcagtgtgagaatggactaatgcagaaggcatacaacctttagaatttgcccccttgagggaacaagatgtgtgaagcaggttcatccatagaaaatgtctgagagaacctcaaaatccctaacctgactaactgatgaaagtgtttctctcctaaggccagtcagtaaagaccagagggggtgactgtttctttaaatgcaaaggcagcagcacaataattcaagaaacatgaaaaatcaagaaaacatgacaccaccagaagaacacaatcattttccaataaccaactccccaaaaatggagatttacaaattggtttataatgaattcagaacaattatgttaaggaagctcagcaaactaaaaggaacaccaatagactactctgtgaagtcaggcaaacaattcatgaacaaaactagaaattcaaaaaagagaaaaattatcttaaaagaaaacccagaagttatggagctaaagaatacaatgcatgaaatgaaggagcgtatcaacagcaaagttgatcaagcataagaaaaaaaaaatctgtgaaactgaagactggctatttgaaattattcatcagaggattaaaaaaaaaagaatgaaaagaaataaagaaagcctacaggatgtataaaacaccatcaagagaactaatataaggattattggagtcataaaggagaagagagaaaagggtagaaaacttatttaagaaataatggctgaaaactctccaaatctaggaaaagatatgagcatccaggtatatgaagctcaaagatccccgtacaggatacattccaaaaagacttcaccaaaacacatgataatcaaactgtcaaaagcaaaatcaagacgatgaataaaccaccaatcactaagagggagacaggattcttatgttgtcattattatttacatataatttcagtaaatgttattggaaaatttataatgttttaaaaaaagaaatttgaaagcaccgaaagaaaagagactcatcacatacagggaacccttttaaggcattcaagagatttctcagtagaaaccttacaaaataggagagagtgggatgaactatacaagtgctgcaaggaaaaaaatgccaaccaacgctttacctggcaaatctgttcctcagaaatgaaggagagagaagaactttcctagacaaacaaaagctgaggcagttcatcaccactagacctgccttacaagacatactaaggggagttcttcaagctgaaatgatatggcaatagttagtaatatgaaatgataaacctcactggtaaaggaaagtacatagtcaaatttagaacactttgatactataatgatggtgtataaataattttactgtgctatgaaggttaaaagacaaaagtattaaaaaaaacccatagctgcaatagcttgtcaatgcatactacagtataaaaagatgtaaattagaacattaaaaacatagcatgcaagggtagggaagtaaaagtgtagttttcatatgtaatcaaatttaatttgttatcagcttaaaataaattgttatacctatgttttatgtaagtgtcatggtaactataaaggaaaaacctctagtagatacacaaaagaaaaagagaaaggaatcaaaacataacactacagaaaattatcaaattacaaaggaagacagcaagggaggaacaaagtaaaaagagcaagaaaaaatttaacataatgaaaacagtaagtccttacgtgtcaataattactttaaatgtaaatggattaaattatccaaacaaaaaaacagactggacaaatggattttagaaacaacaacaacaacaaacaccgcacacacacacacacacacacaaaccacccagccccaactatgtgctgcctacaagagatttacttccactttaaggacacatacaggctgaaattaaaagaacagaaaaagatattgcatgcagatagaaaccagaagagaggagaggcatctatacttacagcatacagaaaagattttaagttaaaaactatatcaaaaggctaagaaggtcaaaatggtgaagcagttaattgttcaagaagacataaaaattgtaaatatttatacacccaatattgaagcacctaaatatataaggcaaatattaatacatataaaaggagaaatatacagcaatacagtaatagtagtgaacttcagtgcctccctttcaaaaatggataatccagacataaaatcaataaggaaacatttaacttaaacttcactttagaccaaatggatctaacagacattatactgaacatttcatccaacagtggtagaattcacattcttctcaagcacacatggaacattctccaggatagattatatgttagctcacaaaataatattacaaaatttaataaagctgaaatatcaattattttgcaccacaatagtataacactagaaatcaataacaagatggaaactggaaatttacaaatatatagcattaacatattcctgaacaaccaatgggtcaaagaaaaaaatcaaaataattttgtgacagcaaagtagaaacacaacataccaaaacatacaggacacagcaaaagcagttctatgaggtaagcttatattgataaacacatttaaaaaaagattttaaataaacaacattacacctcaaggaactacaaggaagaaaaaaaaacaagccccatgttatcaaagggaaggaactaacaaagatcagacagaaataaatgaaacatagactagaaaaacaatagagactattaataaaacttagagttagttttttaaaaaataaaatcaacaaacctttagctagactaaaaaaagagaagactcaaataaaataaaaaatgaaagaggagacattacaactgataccacagacatacaaattaagagaaaactatatgccaacatattagttaacttgcaatgggtaaatccctagaaacatacaacctacaaaaactgaatcatgaagaaatggaagatctgaacagatcaataatgaataagggaattgaatcaatattcaaaaatctcacaaaaagaaaagctcaggatcagatggcttcactggtgaagactgccaaccatttaaaaaaattaataccactctttattaagctcttccaaaaaaattgaagaggagaaaacactttcaaattcattataagaggccagttttaccttgatatcaaagatttaaaaagaacactttgagaaaggaaaattacaggccaaaacccttgataaatatagatgcaaaaatgctcagcaaaatactagcaaacctaattcagcaacacattataatggcatacatcatgaccaagtgagattcatgcctcggatgcaggatagttcaatataatcaaatcaacaaatgttacactactttaacagaatgaaggataaaaatcatatgatcatctcgatggttgaactagtttacagtcccaccaacagtgtaaaaatgttcctatttctccacatcctctgcagcacctgttgtttcctaactttttacagatcaccattctaactggtgtgagatggtatcttattgtggttttgatttgcatttctctgatggccagtgatggtgagcatttttcaagtgtctgttggctgcataaatgtcttcttttgagacgtgtctgttcatatccttcacctactttttgatggggttgtttgtttttttcttgtaaatttgtttgagttctttgtagattctggatattagccctttgtcagatgagtagattgcaaaaattttctcccattctgtaggttgtctgttcactctgatggtagtttcttttgctgtgcagaagctctttagtttaattagaccccatttgtcaattttgtcttttgttgccattgcttttggtgttttagacatgaagacagtgtggtgattcctcaaggatctagaactagaaataccatttgacccagccatcctgttactgggtatatacccagaggattataaatcacgctgctataagccataaaaaatgatgagttcatgtcctttgtagggacatggatgaagctggaaaccatcattctcagcaaactatcacaaggacaaaaaaccaaacaccgcatgttctcactcataggtgggaattgaacaatgagaacacatggacccaggaaggggaacatcacacactggggatggttgtggggtggggggaggggagagggatagcattaggagatatacctaatgctaaatgacgagttaatgggtgcagcacaccaacacggcacatgtgcacatatgtaacaaacctgcacgttgtgcacatgtaccctaaaacttaaagtataattaaaaaaaataatgctgctataaagacacgtgcacacgtatgttcattgcggcactattcacaatagcaaagacttggaaccaacccaaatgtccatcaatgatagactggattaagaaaatgtggcacatatacaccatggaatactatgcagccataaaaaagatgagttcatgtcctttgtagggacatggatgaagctggaaaccatcattctcagcaaactatcacaaggacaaaaaaccaaacactgcatgttctcactcataggtgggaattgaacaatgagaacacttggacacaggaaggggaacatcacacactggggcctgtcgtggggtcagggtagggggagggatagcattaggagatatacctaatgtaaatgacgagttaatgggtgcagcacaccaacacagcacatgtgtgcacatgtaccctagaacttaaagtataataaaaaataaatcatatcatcatctcagtagatttagaaaagcatttaacaatattcaacatcctttcagaactaaaaactctcaataaatcaggtatagaaagaatgtgcctcaacactataaaagccacatatgacaaacctggaggtaatatactcaatggtgaaaagtaaaaagctttgactctaagatcagaaccaaaacaaggatgtccattctcaccacttatatttaacatagtagttgaaattctagctagagcaattaggcaagaaaaaaggcacccaagttggaaagaatgaagttaaattgtctctgtagatgacatgatcttatatatagaaaacactaaagactccaccaaaatgctgttttaattagagcttaaaaaaataattcactaaagttgcaggatacaaaatcagtatacaaaaatcagttgcatttctaaacaccaaaaacaagttatccaaaaaattaagaaaacaatcctatttgtgatatcatcaaaaaataaaatactaaagaataccaaagaaactgaaaataaatggaaataaatggaaagatagcccatgttcatggattagatgaattaatactgttaaaatgttcatactacccaaagcaacctacagattaagtgcaattcctactaaaattccaatgacatttttcacagaaatagaaaacacactcctaaagtttgcatggaaccgcaaaagactcaaatagatgaagcaattttgagcaagaacagtaaagctggagacatcacactacctaacttcaaaattttattaatcaaaacagcatgacataaaaacagacagaaaagaccaatggaacagaatagagagcccagaaataaactcacgtttatagagtcaactaatattcaacgaaggtgccaagagtacacaatggggaaagtatagtctctacaataaacagcactgggaagacaatatccaaatgcaaaagaatgaaattacacccttatcttataccatacacacaaatcaaatcaaaattgataaagacttaaatataagacctgaaaccatacaatctttaggcaaaaactcattgacattggtcttggcaatgatttttttgatatgacaccagaagcacaggcaacaaaagcaaacctaaacaagtgggaccctaacaaactaaaaagtttctgcacagcaaaggaaacaatcaatcatcagaattaaaaggcaatttatgaaatgggagaaaatgtttgcaaaccacatatctgataaagggttaatatccaaaaatatataaggaatgcataaaattcaatagaaataaacaaacaaataatccaattttaaaatgggtgaagaacctgaatagacattttttcaaagaagacttacagataggcaacaggcatatgaaaaaatgcttgacatcactaataatcagggaaatgcaaatcaaagctccagtgaaataccacctccaactattaggatggctattatcaaaaactcaaaagaaaacaagctgggggaatgtagagaaaagggaaaagaagatccttatacactgttggtgtgaatttaaactggaatagcccttatggaaaacagcatggaggttcctcaaaaaattaaaaatagaactactatatgatccagcaatttcactattgagtatatatccaaatgaattaaaatcactgtcttgaagaggtatttgcacactcatatttatttcagcattattcacaatagccaagacatggaatcaacctaagtgttcatcagtagatgattagataaagagaacgtggtatatagacacagtggaatctatttagtgttcaaaaagaaggaaatccaacttttaaaatcctttaaaaagttaaactcataaaaacagagaggagaatggcggtttccaggaactggagggtgggagaatggggagatgttggtcaaaaggtacaaactttcagttataaaatgaataagttctagagatctagtgtacaacagcattactatagttaataataatattttttatacttgaaatttgctaagagtaaatatcaatattctcaatacacacaaaacagaactatctgaaggcactgatatgttaattatcttcattatagtaatcatttcacaatgtataatgaatatcaaaacaatagtgtacatcttaaatatatacagttttgatttgttaatcatacatcaatgaagctagaaaaaatgttgtaatttttaaaacaatagtaatataaattaggggtgaaggaattgacctatgttggagaaaagtttttgtaaactatttaaattaattggtatccattcaagctagattatttttaattgttaatttaattgtaatactaaggcaaccactaaaaaagcctttaaaaaaatatagcacttgaggctgggcatggtggccctcaattatatatataatatatataaaatatatattatatatatagtagatgaacaacaatgggatttaaatggtacactagaaaatatctgtttaacaaaaagaaagcaatagtggagaaatataagaacaaaaccatgtaagatttatagaaaatgaatagcaaattggttgacctaaaccctatcttataattatattaaagataaatgaaataaatactacatcaaaaggcagagattatcagaatagagaagaaaaatccaaaccataattcaaccttatgttatctgtatttagaatatttagagtcaagacacaaatagatagagttccatttgggcgtgaaaatatttaccatgcaaaatgtaattaaaatagagctagagcagcaatactaatatctgacaaaatatactttaacaaaaattgttgctaaagacaaaaaagaacattttataataagacacaacaattataaacatatacaccaaacaatagagcccaaaatatacaaagcaaaaactgctagaattgaagaaagatagaaaaatcaatgattacagttggaggtgtcaataccaaactttcagtaatacacagaacaacaagtcaaaagcaaaaaggaaataaaaaactacacattatcatacaacaccttaatacgatatccaacaatagcagaatacacattattctgaagtgcacatggaatattcttcaggatgacacatattaggctgtaaaacatatcttaataatttaaaagaattgaaataatacagcacatattctctgactgcaaaatattaaaccaattacagaagaaaatgtgggaaattcacaatgatatggagatttaaaaatacttcaaagtaaccaatgaatcaaagaacaaatcacaagagaaattagaaaatattttagatgaataaaactgaagaaacaacataccaaaattttgtggttgtagctaaagcagtgcttcaagggaaatgtataacagtatatccctaaattttaaaaaaatctcaatccaataacctaatttttcaccttaagaaatgagagtgaaagagcagacttaacccaaagtaaacagaaggaagaaataataaagattagcatggagataagtagtgaaaataaaaacaatagagaaaattaataaacttgaaagttggttcttctgatatatcagtaaaattgacgtattattagtttgaccgagaaagaacaaaagagagaagattcaagttactagacataaatgaaagtatagatatcaccttacagaaattaaaagaattctaacagaatattgtgaaaaagtgaatgtcaaaaaattaaattatatgagatacacaaatccctctaaaggcacaaactaccacagctggtgtaaaaacatgaatacaccatttacagttaaaaagactgaatagataaaaattttaagaagaaattgagtaagtaatttaattttcaaactataatcccaagaccagatgttttcattggtgaattctaccaaactttaaaaggattaatatctatttttcatacactctttccagaaaatagaaaaggagggaacactctataactcactgtatgaggtccgtattacccttatatcaagaccaaacatcataagaaaagaagactaaagacttatggtttctgctctgatatgtttggaagtcatcactactattgtcacaaggaaaaatctgaacaaactaaagtcaacgatttcttaaactaaccatagaattgaggtaacgggcgaaaactggagatgtaggcaaatacaaaaaaaatcacagtttatcaggagcagaaactgctgaaaccagcaactcgtatgaacatgttaagtggtaattgacaaatttctggagattgaatgtggactggattgagagttaggaactcctaagtgcccagtttttgatgaccccacacacttttgtaaactagacttccaagagccccagcaagtttcttacagtgaagactgcagaaaaatcccctgatgcttcagataggaggaagggaaaagcaactattttgaaataagcccaggggacaagtagttatttctaaacactctcagagcattttctttcacacggcagggggctccctgcaagggaagctactttgcctgagccttgtctgatgtaggagaaaaggaattggatggctcaagctccatctagcctttctgatttatataagggaagcaaaaaataggttaagaaactcttctgaaagtcacaactcagatttattttatatttatttatttatttatattttttgagacggagtctcgctctgttgcccaggctggagtgcagtggcgcgatctcggctcactgcaagctccacctcccgggttcacgccattcttctgcctcagcctcctgagtagctgggactacaggcgcccagctaattttttgtatttttagtagagacggggtttcaccacgttagccaggatggtctcgatctcctgacctcgtgatccacctgcctctgcctcccaaagtgctgggattacaggcgtgagccaccgcacctggcctcacaactcagatttaaccataagattatagaacacttctcctcccaaaacagagatatagatcaatggaacagaacagagccctcagaaataacgccgcatatctacaactatctgatctttgacaaacccgagaaaaacaagcaatggggaaaggattccctatttaataaatggtgctgggaaaactggctagccatatgtaaaaagctgaaactggatcccttccttacaccttacacaaaaattaattcaagatggattaaagacttaaacgttaggcctaaaaccataaaaaccctagaagaaaacctaggcattaccattcaggacataggcatgggcaaggacttcatgtctaaaacaccaaaagcaatggcaacaaaagacaaaattgacaaacgggatctcattaaactaaagagcttctgcacagcaaaagaaactaccatcagagtgaacaggcaacctacaaaattttcacaacctactcatctgacaaagggctaatatccagaatctacaatgaactcagacaaatttacaagaaaaaaacaaacaacctcatcaaaaagtgggcaaaggatataagcagacacttctcaaaagaagacatttatgcagccaacagacacatgaaaaaatgctcatcatcactggccgtcagagaaatgcaaatcaaaaccacaatgagataccatctcacaccagttagaatggcgatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattgctatatatatatatatatacccaaaggactataaatcatgctgctataaagacatatgcacaggtatgtttattgcagcactattcacaatagcaaagacttggaaccaacccaaatgtccaacaatgatagactggattaagaaaatgtggcacatatacaccatggaatactatgcagccataaaaaagatgagttcatgtcttttgtagggacatggatgaaattggaaatcatcattctcagtaaactatcgcaaggacaaaaaaccaaacactgcatgttctcactcatagatgggaattgaacaatgagaacacatggacacaggaaggggaacatcacactctggggactgttgtggggtcgggggaggggggagggatagcattaggagatatacctaatggtaaatgacgagttaatgggtgtagcacaccagcatggcacatgtatacatatgtaacaaacctgcacattgtgcacatgtaccctaaaacttaaagtataataataataaaaaaaggctacctaaaaaaaaaaaaaagaacacttctcctcccaacaccatatcaccacatcaaccaggactccagtgtaatagcagtgaattctaactgaaagaggtgaaagacactgattgtatttaagaaagatcttctaaggaaatccaaaaatagtaggggagatcaaaacaaagatactagaggaaattgaatatgtgacacctatagctacaaaaaaattaaacataacatagccctaaccatataaacataaaacctcacacaaagacctattatctgagattctgttgcctgatacattgcgttttatttcaataaaaaaattagagggtatgttaaaaagcaggaaaagttagtctaaagagacaaattgagcctcagaagtaggctcagatatggcagagatttggcaattatacctagagtttaatataaatgattaatataataagtgttctaacagaaaaaggcaacatgcaagaacggatgggtaatgtgatcagcaagaaggaaactctaagaaagaagtcaaaaggaaatgctaggaataaaaacctacaagaaataaagaatgcctgtgatgggttcctcagtagactggacaaggtcaaagaatcagtggatttgaaaatatgtcaacaaaaactgccccactgaaatacaaaagaaaaatagaattttaaaaacgtaacacaatctccaaaacagtgggacaattacaaaagatgtaatgtgcctaatgcaaatgacagtaggagtataaagggagaaaggaatagaaaatctgaagtaataatggcagagagttttccaaaattaatgctaaaccacagatacagcaagcccagagaacaacaaggaggaaatttagtaaagcgtctgcaaccaagtatgtcatattcagactgacaaaaccaaaggtgaagagaaaatattgaaagaagacaaagaggaaaataaatatcaagaaaatacatacgaaatacatcatacatacataagaaatacatcagaccatacaagcaagaagagaatggagtgaaatgtttaaaatgttgaaaaaaaaactatcaatttgcaattctgtatccagtgagattatctttcaaaagtgaagagggaaatggcagagaagtcatctccaagacctatggtttcccttcacagaaacactgaaaaatatgaacaaaagtggtcagaattaactttctaagaattctataaaatggtaaaatgtttacaccagtaaagcaaatgctgaattgagaaggcaacttaaaaaggtgaagaaaacttcgtattatttttatgtgtccttgccccacgtccttccctaccttagtcttgaagatggcagcccacatttctactgtggggctctggtttctgtttcctggttcaagagggagaataacagaccttacttttagtcattattatttccttctttctgatttccttgggtttattttgctcttctttctactttattgaaatgagaactaagattatgatttgagacatttttctaatgtaagcatttagtgctataaatttccatctcaacactgctttagtcacatcccacaaatttttatatgttgtaatttcactttcatttagttctatttttaaattttttctttttatacttcctctgactcacagattacttagaattgtgttgttcagttttcaaggatattgtagattttcctgtttctctgttgtctaatagttctgttccattttgtacagatagctcacgctgtatgatttcaattttttaaaaaattgtgctttgttttatggcccagatatggtctgtgctgtgaatattccatgttattataaagtatgcctgttatattattatatatatataatatatataattataaagcatgcccgttttgtattgttagcagagtattctagaaatgtcaatgagatcttgttggttgatggtgcttttcagttctatatctttgctaattttttttttttttgcttagtagctatatgagattctgagagaggaaattgaagtctccaaccataattgtggatttgtctatttctcctatcagttctatcagtttgtgcatcacatatttgaggctctgttgtttggtgcatacacaagtggaatcattgtgccctcttggtggcttattttatgattatatagtgcctatctttgtggtatttttatttgctcttaaatctactttgtgttatattcatatacccattcttttttaaaaaaaattgtttgcgtgatacatcttttccattcttttaatctcagcctatctgtgccattgaatttgaagtgagttttcatatagagaacatattattgaatcatcattttaaaaattccttttgccaatcttttttatactgaggtaaaattgacataaaatttatcattttaaagtgtacaatacagtggcatttggtaatacacatgttatgcaacgttaactctacctggctcctaaatgttttcatcatccccaaaaggaaacttcatactcattaagcagttaattcccattccttctctcggccactggcatccgcaaacctacttttctgtctctatgaatttacctattatggatattttgtataaattgaattatacaataagtgacctttatgtttggcttcgttcgcttcgcatactatttttcgatattcaaccatgttgtagtatgtatcagttttatttgaataactcaattctttttgttgtatagctaaaagttgattcctaggtcataatgataattctatgtttagtttattgaatagctgccaaagtttttccacagtggctctgtcattttaaaatcccactagcaatggatgagagttccaatatctccacatccttaccaatattgttattttatatttttataattataattttcctagtgaatacgcaatggtatctcattgtgtttttggtttgcctttccctaatgactaatgatgttgagcatcttacaatgtacttgttaactatttgtgttctttagagaaatgtctattcaagtgccttgtccattttaaaaatcgagttgtcttgttgacttatgagttctttaatacagtaaacgcttatcagatatgatttataagtattttaacccattctgaaggtcaccttttcacttttgtggtagaccattatgcacaaaggttttaattttgataaatccaatttatccgcttttgttgttgtttttgttgttcgtgcttttgcaaaacctagtgtcatgaggttttctcattatctttggagaattttatagtttgggtctatacatgtagattattgatctaatttccattaatttgtgtgtatgctacgaggtaggggtccaaattcaatttttgcattgaattgaaaattcatattttcagtttcaaatttcaactgcatattcagttgttgcagcacaatttgttgaagagatcattctttaccacagggaatgatctgggacccttgtcaaaaatcaattgatcatagatgtatgggattatttcagactttagatcttgttccatgaatatgcctatttttatgccagcactgcagtattttcattactgtagctttatcataaattttgaaatcaggaagtatgtatcctccaagtgtgattttcatttgctagagtgttttgactatttggggtctttgcaattccatatgaatttcagaattggcttttcatttaaaaaaatggtagttgagattttcataggaattatattgaatctacagatcactttgggtagtattgccatcttaacaatattgtattccaatccataaacacggatgtattgccattcatatctttttttcttttctttcggcaacatttagtatatgacacttgtaactccttggttaaatttatacctaagcattttatcctttctgatgctgtttaaatggaattattttattaatttctcttttagatggcttgttgcaggtgtatagaaatagaactgattattgtgcttttattgaattatctgaaactttgctgcatttattaactctagtaggttttttttttctttaaagttgtctatatatcttgctctgtgaatagataattttacttcttgatctccaatatggatgcctttctttctttttcttacctaattgctgtagctagaattttcagtataatgtatgatagaagttgttcacaactatccttgtcttctttctgatcctaggggtatagctttcagtctttcaccattaagcacaatgttagctgtggggttttcttagatgccatttaatatattaaggaagtgctctgctatttctaattggttgagtatttttattataaaatggtgttagattttatgactttatgtactgcataattgagattatcatgtggtcttttcattcgattaatgtggtatattttatgattttcatatgttgatccacctttatattcttggggcaaatcccactgtgtacacgggttttttagggtctcctaattttcttcattctttttcttttctctccctgagactgaataacgttaactgacctatcttcaagtttactattttttcttctgctgttcaaatctgcttgaacctatagagtgaatttttcattttacttattgaacttttcagctccaaaatttctctttggctactttgtataatatctatctctctatagatattctctatttggaaagacatttttctcctggttttctttacttatttgtattttttaaagtctttaagcatatttgagacagttgatttaagtatttgtgtactaagtccattgcctaagcttttgcatagagattttatattaatttcttttttttctgtgaacaggtcttttttttttttttttttttttttttttttttagaaaactggacattttgagtagtataaacgtggctattttagaaataattttcctccctccttaggttttgtttccacttgttgcatgttgctgttgtttgctcattagtgacttttctaaagtattttgaaaagtctgtgttcttgatcatgtgggtccattgaattctgtattctgttaatttcatagtcagctagtgttctgaaagttcccttaagtgcatagagccaataaaagaaaaagaaaagaaacacagaaaaagaaaagaggaaaaaaggagggaaagagatttaaaaaaataatgtcggttgggcatggtggctcatgcctgtaatcccagcacttttgggaggccgaggcaggcaaatcacttaaggttgaccatcctggccaacacggagaaaccttgtctctactgaaaatataaaattagccgggcatggtggcacatgcctgtaatcccagctactcgggaggctgagaggtaggagaatcacttgaactcgggaggtggaggttgcagtgaactgagatcacaccactgcactccagcctgggcaacaagaatgaaactccatctcaaaaaaaaataataataataatgcctttgccgatttgctctgtgtttgggccctcattcaatgcctagtcaggccatttacaactctctcttaactttcactacctgcttgtgtactgactgaaggccacctataggtgaaagcttaacatcatctcagatctttttggaccatgaatcctaccctgggtatgcacatgatcttcttaatttcccagtagatgcaagagttttagtgttttaaaagtccttattccctcatctatcttcttttctgacctttttcagtctgcttattgttcatctgaactgacatcctttgccccaagcggctgtggcaaaaacttttacctttaaatgctttcaccacaagccacttgggaagctgccccagacctgggactgctctgaccctgatgaaacaaagacaagaccttgtacagccaggcagccataagacaagtccatacccaaaccacagttctttcagaataaggtctatattggattctctggccctagtaaccagcatgagtctgggcttgccatcttcatggccacttgtcttagtttgctagggctgccataacaaaatatgagagactgagtggcttaaacaagagaaatttattttttcacaattctgaagaccagaagtccattactctgaaatctctctccttggcttgcagatactgccttcttgccgtgtcctcacacagccttttctctgtgtacacatccctggtgttttttaagcctgtccaaattttctgttcttctgaggacaccaatcagattggattagcgaccacccatatgatcattttaccttaagtacctcttcaaaggtatcagagtagtatatttgctacagttgatgaacctgcatacaacatcatcacttgaggtctgcagtttacattagagttcatcgttagtgttatatattctagggtttgttttgttttgagacagaacagagtcttgctgtgttacccaggctggagcgcagtggtacaatctcattgctacctctgcttcccagattcaagcaattctcatacctcagcctcctaagtagctggaactacaggcgcacaccaccatgcccagctaattttcgtatttttagtggagatggggtttcaccatgttggccaggcaggtcttgaactccttgcctcaagtgatctgcccgcctcagcctcccccagtgttgggataacaggcatgagtcaccatgcctggccttattctatgggttttgaaatgtataatgacatgtatccatcgttgtagtattagatagaatagcttcattaccctaaaagtcttctttgcactgggttgagttttaaaagctctttgattattttatgacagttccttattagatatatcttttgcaagtatttttatcagtctgtggttatcttgtcttttacagagcagtaatttttaattttaataaaatccaatttgtcaattacttatctcatatgactctggtgttacatctaaaatgttaccaccatactcaaggtcacctaggttttctctaggaattttatggttttgcattttacatttggtgtatgacccatttgaagttaatttttgtgaggttgtaaggtctgtgcctagattcattttttttttttttggcatgttacttcagtattcataagaaacattgttctgtaatcttctttcttatagtatcttagtcttgctttagtttttgggcaatgctggcctcactgaataaattcaaagtgttccctcctcttcaattatttggaaaagtttgagaaagactattgttaactgttttctaaatttttggtggaatttaccagtgaaccaactggtcctaggcttttctccagtaggtggttttgattatgctttcaatctctttacaagttacacatctatacagacttttataattcagtcttggtaggttgtgcgtatttaggaatctgaccacttcatctaagttatccaattagttggcatgcaattattcgtagttctctgaataatcatttttatttccacaaaattggtaatatcccagtttccattttttatttcattgaatcttcttttttcttagctaatctagctaaatgtttgccaattttgttgatcttttggaagaaccaacttttgatttattaattttctctactctttttctgttctttatattatttatttccacactaatctttactattttcttccttctgttggcctttaattttttttttttaatttttaaggtgtaaatttaggttgagaaattttttaaatgaaagcatttagagctataaattttccttctggtgttcctttcactacctgccataaattttgatatgttgagtttttgtttgtcttggagtattttctaatttgtcttctaatttcttccttgacctattggttatttaaatgtatttaatttttgcatattgtggatttcccagttttccttctgttattgatttctagttttattccattgtgatcacagaagatattttgtataatcgcagtctattaacatttattaagtcttgtggcctaacagaggatctatgttggagaatgttccaagtgcaattgagaatactattctggtgctattaggtgaagtattctctatatgtctgttaagtccaattcatctatagtgttgacgtttcctgttccttactgattttctgacttattattctatccattattaaaagtggagtggtaaagtctctattattgtagaactctctgtttttcaagtctatcaatatctgtttcatatattttggagctctgtttgctgcatatgtgtttacaattgttatatcttcttggcaaattgaccagtttcatcaacataaaatataattcttattgtcttctaacagtttatttttctttttacataaagcctattttatctgatcttagattccctcacactccaccccagcacgcttttggttacatttacataatatatcttttccatcctttcattttcaacctgtttgtgtctttagatctaaagtgaatgtcttacagacagcataagctatgtcattaaaaaaatccattctgcttatctctgccttttgactggggagtttaatccatttgcatttaaagtaatcactgatcattaaatactttcagtattttgttgttttatgtatgtcttataactcttttgctcttcatttccttcaatattgcctttgtgtttagcttatctttttgtgtcacactttgatccccttctcatttcttttttatattttctttgtggttaccaggaggacaatgtatcaacttttaaagttattacaattttatttttttaaatctctcccattcggggattttaggaaggttaaataataatgtaaatgagatacctagaacaatataagcattcaggaattattaactcaattccaatccttcctccacctccacctctttctctgtgagattatagaaaagatgacaaaaaggatgttttctgagccctttaattgttgagaatgatctttgagaaaaagaaaaaaaatgaaagcactaggaatgtacaacagcctggaagtataattaagtgtaaattaaatagataaaagttataagcagaggaaagtatagtagaactcagtatttaaaagagaatcaatgtgaaaattatataaatttatgtaaaataaaactaccagacaaatctgatatccttaggatttttctttctttcatgtgatttctaattgctacatatgacactaaaccattgatctgagctgtaagagaaactggaaattgttctgttatcttttgtaagatttctagaacattttgccctcagacttaaatgccaacgtatttctcacttattgtttactgcttttggatttacatatgatttgattctttcttatctcttatccttacaatgtaattcaaactgatgccaatttaagttcaattgcgtacaaaaactctactcctatgcagctccgccccatctaatttacattattgatgtcgcaaattccatctttgtacatagtttacatattaacatggatttatacatttttatgtatttggtttttaaatcctgtagaaaataaaaagtcaacacaccaatattaaaataatactggtttttatatttgtccatgtgcttacctttatcagtgttctttacatctttatacgggtttgagttactgtcttgtgtcctttagttccaacctaaagaactccctttagcatttttatagggcaggtctagtggtaatgaactctctgagtttttatttagggatgtcttaatttctagctcctgtttgaagtaaatttttctggatatacaattctctgttgattgatttttgttcattttcccttcagctcttttaaatacattatcccactttcttctgccttccaaggtttctattaacaaaattcagcttataatcttattaaagatctcatgtacatgagtggcttctctcttgctgttttcaagattctgtgactttggtttctgatagtttaaatataatgtgtcttattgtgggtctctttggatttatcctagagtttcttggtcttcttacgttggtatatccatgtatttcaagacatttgagtagttttcagccattatttcttcaaacaatctctcctctttggggacttccattttacctatattggttcttttgatggtgtggcaccagtcccctagactttgttcacttttttccagtcttttatttctgcttctcagactcaacagcttcaagtgttctgtattcaagtctgctgactctttcttcttccagctcaaatctgctgttggatccccccttgtaaaatttttaattccattttagtgtttttcaagttaagtatttttattaggttcctttttataatttctttttgttgatattctcattttattacacataatttgtctgatttccattagtttttttctttgttttcctttagctctttgaaaatatttaagacattttaaaagtctttatccaagttcaatttctatggttctgtagagatattttctgccagtttatgttcttcttttccatgggccatgttttcctgtttctttgtatactttctaatttttggttgaaaactgagcatttgaaaatagagccaactttcccagtttctgcagagagtctttatgccacagtattcgttcactgattaactgggtatatctaagcttagggagcagctgagtcaaaagtttaaggtcttctcaggtcttttctgagtatacatgtttcctatgcctgtgtgaaatgttctcaatttccctatataaacagctacttcttcttttttttttttttttgagatggagtctcgctctgtcacccaggctggagtgcagtcatctcagctcactgcatcctccacctcccaggttcaaacaattctcctatacaggtgtgtgccaccacgtctggccaatttttgtatttttagtagagacagggtttcgccgtgttggccaggctggtctcaatctcctgacctcaggaggattacaggcttgagccacagtgtccagcctaaacagctacttttgaatgctttaatttcctgaatagtctcaacccagtttttccttgaggtcttaggtggtccattgtatgtctccacccatagttgcttgccccaggcatctgtgggtctgtggtaccactgcagctttcaccacctgtagctgccacctttccctatctgagatccaggttaggtgagagagatcattccttcacgcagtcccatgacaggttggaacatttcaaataaggtctgttctgctcctctggttgaagggagaaaattgggaaccggtttcccaccttctacaaaccaagatctcatgttgccacgggagtggcagggcaagtgcaagtgaaaatgccatacaattttctaccattttgaacgcgggtttttcttcaatggtcatttgcttggttgctgtaggcctttcactgttttccagagctcccataagattactttagccagttttttgttctttcctgatgcttccctggcagagtaagggttggaacttccaccattttgctgattcataactctgtagtcagttttaaatatattgatacttgagtttgttttatggcccagaatatggtcttggtaaatgtttcacatatactcagaaagaatgtgtattctgatgttgttacatgggctgttctataaatgttacttaaggtggttaataatgttgctcaagtcttctatattcttgctgattttcttttatttatttattttattttttttattatacttttaagttctagggtacatgtgcacaacatgcaggtttgttatatatgtatacatgtgccatgttggtgtgctgcatccattaactcatcatttacattaggtatatctcctaatgctgtccctccctgctccccccaccccatgacaggccccagtgtgtgatgttcccctttcctgtgtccaagcgttctcattgttcaattcccacctatgagtgagaacttgcggtgtttgtttttttgtccttgtgatagtttgctgagaatgatggtttccagcttcatccatgtccctacaaaggacgtgaactcatccttttttatgactgcatagtattccatggtgtatatgtgctacattttcttaatccagtctatcattgatggacatttgggttggttccaagtctttgctattgtgaacagtgctgcaatgaacatacgtgtgcatgtgtctttatagcagcatgatttataatcctttgagtatatactcagtaatgggatgggtgggtcaaatggtatttctagttctagatcttgaggaatcaccacactgtcttccacaatggttgaactagtttacagtcccaccaacagtgtaaaagtgttcctatttcttcacatcctctccagcacctgttgtttcctgactttttaatgatcgccattctaactggtgtgagatgggatctcattgtggttttgatctgcatttttctgatggccagtgatgatgagcattttttcatgtgtctttggctgcataaatgtcttcttttgagaagtgtctgttcatatcctttgcccactttttgatggggttgttttgttcttgtatatttgtttgagttctttgtagattctggatattagccctttgtcagatgaggagattgcaaaaattttctcccattctgtaggttggctgttcactctgatggtagtttcttttgctgtgcagaagctctttagtttaatgagaccccatttgtcaattttggcttttgttgccattgcttttggtgttttagacatgaagtcctcgcccatgcctatgtcctgaatggtattgcctaggttttcttctagggttttttatggttttaggtctaacatttaagtctttaatccatcttgaattaatttttgtataaggtgtaaggaagggatccagtttcagctttttacatatggctagccagttttcccagcaccatttattaaatagggaatcctttccccatttcttgtttttgtcaggtttgtcaaagatcagatggttgtagatgtgtggtattatttctgagggctctgttctgttccattggtttatatctgttttggtaccagtaccatgctgttttggttactgtagcctcgtagtatagtttgaagtcaggtagtatgatgcctccagatttgtccttttggcttaggattgtcttggcaatacaggctcttttttggttccatatgaattttaaagtagttttttccaattctgtgaaggaagtcattggtaacttaatggggatggcattgaatctataaattaccttgggcagtatggccattttcacgatactgattcttcctatccatgagcacggaatgttcttccatttgtttgtgtcctcttctatttcgttgagcagtggtttgtatttctgcttgaagaggtccttcacgtcccttgtaagttggattcctaggtattttgttctctttgacgcaactgtgaatgggagttcactcatgatttggctctctgttagtctgttactggtgtataagaatgcttgtgatttttgcacattgattttgtatcctgagactttgctgaagttgcttatcagcttaaggagattttgggctgagacgatggggttttctaaatatacaatcatgtcatctgcaaacagggacaatttgacttcctcttttcctaattgaataccctttatttctttctcctgcctgattgccctggccagaacttccaacactatgttgaataggagcggtgagagagggcattcctgtcttgtgccagttttcaaagggaatgcttccagtttttgcccattcagtatgacattggctgtgggtttgtcataaatagctcttattattttgagatatgtcccatcaatacctaatttattgagagtttttagcatgaagggctgctgaattttgtcgaaggccttttctgcatctattgagataaacatatggtttttgtctttggttctgtttatatgatggattatgtttattgatttgtgtatgttgaaccagccttgcaacccagggatgaagcccacttgatcatggtggataagctttttgatgtgctgctggattcagtttgccagtattttactgaggatttttgcatcaatgttcatcagggaaattggtctaaaattctctttttttgttgtgtctctgccaggctttggtatcaggatgatgctggcctcataaaatgagttagggaggattctctctttttcctatttactgtacatttattccaccagtgactaaaacaggtgtatcaataaaatctgttccctcaggttttgcttcaggtattttgagggtctgttatcaggtgcataaacaagattgttatgtcctattcttaaattaatctccttataattatgaagttaattttttttttcttgagatgcagttttgctctgtcgcccaggctggagtgcagtggcacaatctcggctcagtgcaacctctgcctcctgggttcaagcatttctttgcctcagcctcccgagtagctggggttacaggtacctgccaccacgcccggctaatttttttgtatttttagtagagatggggtttcaccatcttggccaagctggtcttgaactcctgaactcttgatccacccaccttggcctcccaaggtgctgggattacaggtgtgagccactgcgcctggacctggcccgaagtaaacttctttacccttgctaatgatctttgctctgaagcatgctttgctggtattaatatagtcattccttctttctttgattcatgtttgcagggtatatctgtttccattcttttacttttaacctattgtctttatatttaaagtgcatttcttgtaagtataattggtttcttaaaatccaattatctgccttttaaatgtcatttttatatgatttgcataaatatgattattattacagctaaattgaaatctgtcatcttgctatttggtttctatttatcccatttttttcccctctttttttgctttccttgagattgaacattgtattagttttctagggttgctgtaagaaagtgacataaagtggatggcttaaaacaacagaaatttattgtttcagtttggaggctagtcatctgaaaccaaggtgtcatcagggccgtattctctctgaaacctgtagggaagaattctttcctgcctgttctagcttctagcattttccagcaattcttggcattcctttgcttgtagatgtatccctccaatctctgcctctatcataacatagccatcttctccctttatctgtctattcttctcatcttataagaacattaattactgaattggggcccagcatagattaggcctaatctcatcttgaataggttacatctgccaaagattcttcttccaaataagatcacttttacagcttttacaggtactgagagttagaacctcaatatatcctttggtggggaccgacctcttacccataaaaagtattttatatgattccattttatctcctttttaggttattaactacaatttttttttcttttttttgagatggagttttgctcttgtagcccaggctggagcgcgattttggctcactgaaacctctgcctcccgggttcaagtgattgtcctgcctcagcctcctgagtagctgggattacaggcatgtgccaccgtgcctggccaatttttgtatttttagtagaaacagggtttcaccatgttggctagggtgggtctcaaattcctgaccttaggtgatccacccacctcggcctcccaaagtgctgggattacaggcgagagccaccacgcctggctttataatttttttttaattcagtggatgttttagggtttatagtatacatctttatcacagtctagctccaagtgatatatccctttatgtatagtacatgacccttacagtagtgcatttccatttttcctctctggcatttaggctattgcacacacatacactcaattcatccctttgtgtagatccgtatttccagctgctatcttttgcttctgtctgaaatatatgtatgatttcttttatgactattttgagaaatttggttatgtgcatttgtctatttttcttatgtacttttagctcatcaatcttaagtctgtgagtttatagtttttaaaaacaaatttgaaattatttggctattatttcctcaaatatttttttctgccgcccctgctttccctttccttagggatctctgatttccacctatattactctgattgaagttgttccacgtctcttttgaaaatctctgaaaaatcttttatcatttggataatctgtatttgtacatcttcaagtacattaatattttcttttgcaatgtttaatctgctgttaatcccatgtagtggattcttcatctcaggtattgctgttttaatctctagaaattccattgaagtcttacttgatgaaaaaggcagataaaaacaaatgttggcaaagatatggagaaatcagaatctgcacacactgatgatgggaatgtaaaatggtcaaggcaatttggaaagcagtctggcagtttctcaaaaggctaaacgtagttcccatatgacagcaatcattcatctaggtatatactccagagaaataaaaacatatccacaccagaacttgaacattaattttcatagcaacattattcctaggggtttaaaattttttacattatttttatttaaaatagagacagggtctcactacgttgcataggctggtctggaactcctggaattaagcattcctcctgcctttgtcctgttttctccactggaaaagaataaaactttgtacacttggactaacaactcccgattccctcctttaccaacatgccccacagcctctagtaacttactctctactttcatgaattcaacttttttaagattccacatataagtgagatcatacaatatttgtctttctgtgcctggcttatttctcttagcataatgtcctccagattcatacatgttgtcttaaatgacaggatttaccttcctttaaaggctgactagtacttcattgtgtatatgtatcacattttctttatccacttatctgttgatgggcacttaaattgtttcaatgtcttggctactgtaagtaatgcttcaataaacatgggaatgaagatatcccttcaacatattgatttctgttcttttggataatactcagaagtgagattactggatcatatggttgttctatttttttcagaaacctccatactgtttttcatagcggctgtactaatttacattcccactaacaatgcatgagttcacttttctggacatcctccccaacacttgttatctttcatctttttcataaaagccattatataataggtgtgaagtgacatctcactgtggttttgatttgcattactctaataattagtgtgagcattttttttttttcatgtaccgaatgtcttttgagaaaggtctcttcattcctttgcccattttaaaatcaggtggttttcttgctcttgagttgtttgagttccttatgtattttagatatttacccatttccagatatatcatttatattttttcctattctttgagttccctcttcactgtgttgtttccattgctgtgcaggtcttttattttgatgccaccccatttgtctatttttgccatgcttttgcagtcatatccaaaaaaatcattcccaagaccaatgctgtggagatttccccctatgttttcttcagtaggtgtacagttttaggtcttatatgttaagttttaaatctatttttttatatggtgtaaataagggtctaatttaattcttttgcatgtggatatccagttttcccaacaccatttattgaagaccctgtccttttatacttttcagtatgcagatcttttacctccttaaatttacacctcagtatttaatatttgttgctattatgagattttcataatttccttttcagatagctcattaatagtagatggaaacactactgatttctgtaagatgattttgtattacggaactttactgagtttgtgtatcagttctaccaggttttagttttgttctggtggagacattacagttttttgtatatggttatgtcatcagtaattacagatgatttaacctattcctttcctattaggatgccttttttttctttctcttgtccaactgctctggttaggacttctagtactatgtcaaaaagtgatgagggtcgtacatggcctccatacctaatctgttgagagtttttaccatgaaaccaggttgaattttgtcaaatgctttttctgcatccattgagatgatcatatgatttgatttacaccctccattttgttatgtggtatatcacactttttgatgtgcatatgttgaaccacccttgcatcctaaggataaatcccacttcatcatggtgaatcattctttgtattcgtgaatccagtttgctaatatattgttgaggatttttgcatccatgttcatcagggatattactttgtaagtttctgtccttaaagtgtctttctctggctttaataacagtgtaacactacccttgtaaaatgaatttagaagtattccctctgcttcattgttttggaaaagtttgagaatttttattagttctttaaatgtctggtaaaattcagtagtgaagctgcctaatcctgggctttcctttggtgggatactttttattactggctcaatctcttttcttgttattggcttattcagatttgtttcttcatgattcactctttgtaggttgtatatgtctaggaatttattcatttctttaggtcatccaatttgatggtgcataacttcatagtagtttcttataatcctttgtattttggtgatatcagtagtaaatgtctcctctttcatttctgatcttatttgagtactctttttttctcctagtctaggtaagaatttgttgattttatctttcaaaaaaaaaaaaaaccaactcttagcaactcttagttttgttcatttttttccagtctttatttcaactgtgatctttgttacttacttctttatgctaactttcgggcttagtctgttcttttcctagttcctttaggtgaaaagtgagattgtgatccttcttctttattggcgtaggtttgtatcgctataaatttccattaggactgattttgctgcatcacataagttttgtttccattttcatttgtctcaaggtaattttttatttactttttgacttcttctgtgaactattagttgtttgggagcatattgtttaatttccacatattgctgtattttccaccagaattgattcttgttcttgatttctagtttcacgccattgtaatcagaaaagggatttgatatgatttctgtccacttaaacttaagattagttttgtggactaacatatatcctggagaatgttccatgggcatttgagaacaaaatgtattttgctgcttctggatggaatgtttcatatatgcctgttaagtccgtttggtctaaagtgtaattgaaatccattgtttctttattgattttctgtctaggtgatcaatctgcccatggtgaaaagtagagtattgaggtcccgtattatagtattgcagcctatctccctcttcacatcatttaaaaattgctttatgtatttaggtgggtcaatgttgggtgcatatacttttacaattgttatgtcttcttggtgaattaatccctttatcattatataacaaacttctttctttttatagtattgacttaaagtctattttgtctgatagaagtatagctacccctgctctcaatttccatttatatagaatatctttttccatcccttcactttcagtctatgtgtatgtttagtagaaaagtgaatctcttgccgggcgcagtggctcactcctgtaatcccagcactttgggaggccaaggcggcgggatcaccagaggttgggagttagagaccagcctgaccaacatggagaaaacctgtctctattaaaaatacaaaattagccaggcgtggttgtgggcccttgtaatcccagctactcgagaggctgaggcaggagaattgcttaaacccgggaggtggaggttgcggtgagctgagatcatgccattgcactccagccttgacaatagcaaaactccgtctcaaaaaaagaaaaagaaaaagaaaaaaaagtgagtctcttataggcagtatgtggttgtgacttaaaaaaaaaaaaaaatccattctgtcattctatgtctttttgttggagaatctaatccgtttacattcaaggtaactattggtaagaaactgctagtgtcattttgtaatttgttttctgattgttttgtaggtcccttgtttcttttttccctattgctaccttcctttgtggtttggtggttttctgtggtggtgtgctttgaatcctttcttttatagtatatgcgattaccattgtatttgctgtaaggctaacttaaaacattttatccttaggctactttaagcgataaaaacttgcctttagttgcatacaaaaactctacgctttcacaacccccccgcctttcgtgattttgatgtcaaagtttacacttttttaaatttgtatctcttattgtagctacagttacaattacttcttgtagctacaacttattgtagctacagttgtttttaatagtttcatcttttaaacctcctaataggaataacattgctttacctgccacctttacaatactagagaattctgactatgaattacttataccatttagttttttacttttatgtttctcattaactagcagtcttttatttaagcctaaagaactcccttttagtaattccagtagagcaggcctagtagtgacaaactcccttaggcattgtttatctggaaaagtgtttatttctccctttgccaagtaaagtattcttaattaacagctttgtttccttcagcactttgaatataccatcccactctctactggcctgtaaggcttttgctgataaagccactgaatctgtattggggctaccttgaatgtgatgtttcttatctttgctgctttcagtattctttgtctttgatttttgataacttggttgtgatgtgtcttggtgaactctttaggttgaatctgatcggtgacctcagcttcctgttcctgaattttgtcatcttttctcagatttgggaatttttcagctattacttccttaaatatgctttctaggcctttttctttcttttctccttaaggacctcctattatgcaaaagttagctagcttgatgtgtcctgtaattcttataggcattcttttttgtttttgtttctcattggataatttcaaatgtcttacctttgagctcattgattcttctgcttgatcaagtctgctgttgaagcgttctacttagattttcagttcagttactgtattctttatctttagaatttctattgtttttgtttatatttgttaaacttctcattctgttcagatgttgttttccaaatttcatttttctatccatattttcttgtactttgttgaacttaagaggattagtctaaattatttgtcatttcacaggtctccatttcttctgagtctgttactggagctttcatatccaatgtacaccagaaactttgctaattccacagtaaatgttagaaatgggtttttattgataaaatcagtggcttgctaattagtatgttagaagctggcttgcattggtgaagttgagggtattcgatatacgtatcccggctaaaatacttctaaagaacctctccagctttgcaagaatagagtataggaatctgaggaggcctttaacatggccctcagaaaggacacacagggcttgacctctaaacatataaacatatacagaaacgaggtcagaacatgttttgactgatgccagtagtaacacagcagagcctattgctggtcactgttaccaataccttgtgtaataaacctttcatttaaattgagaggttgtaagccccgaaaaagcaaagggcttacagtacctcttgcctgaacactcctgtgtgtgctttctaagaaatgcttttaaaataatgcctgtggcacaaattgatttgacactggctctctttataagctgctatcaaggttgtggggaatagctaactcttacccactttccctgacaaataggaacccgtagttacctaccaaaagtatgtaaaagctatatccgacccaaaggccagttaggtcaaaacaccttgaaaggagctcagtttaaggaaatcagtggtgtcacagtgccccactagcgtgtaaaagttttcatagtttgactatcggatgtgcttagtttcacagctgagtcttaccttgtgatacttttagagcaaaagtcaaatcaaagatgatttaaaaaaacatttcaaagattcataaagaataaatgcctcctcaggaagtcttctggagttctgcccacttcccttaggtggctctttactgtgcccatctcatagcctgtctccttccacttggtgtattgcagagtaaagctcactgtttacaggggtggtagaaagtgtggtcctttcccagactcctttttcccttcctcttctcatttttcagaagatgtgtttgataataaacgaaacaaaatgactaacacattgagctgagctacataagcagatgtcagtttgacgtgaagagtttaaaagatctatgcattatctggggactcctcccccagacctgaaggatcaggtgctgccttctatgccacctgtgcagacagcaaaagaggaaaaccatacccacgttcagtatgaacaaaggggacatttgaactctgtgtggacccctcattggaagggtgtttcttctcctgctgcatccacaaagagcactccttagccttgccttttgtcagttctctctccaataaggcttgagcagagacaacccagtgcagttcagagagactgaagtctggtgttccaggtctgagtcctagctctagctctctgtgtaactttgggatgtcccaaagtaacttttcacaacttgataggtgttaacttgaattttggatacaggtgactcttagcccatcccctctctgtgcttcagatatgtcatcacttgggccatatgacctctggacacctttcctactttccacaatttcagagcagcagagcagactggagctcctgctgcctctgagcttcagtgaattatcactcgttggagggaagcttcaagcattttgttatctttcaagagcaaacacagtgtctgtcagcaagaatatgtagcagatgctagtgaacagcagtgattagggttgaatgctggatttaaatatggagcttaggctgtgaaggaagcctgaagaacctagagccccatgaagctgccctctgtgagatctgacaccatttcccactgatgagccatgggtctaatgggtagcactgattccacatacagtatgtgagtgcaatacagtgaaagcaaagagaataaaatgatggctaacatgatgttccaaactttaaacaggagaaaaacacacaattccattatgtataagaacccacacagagatcaggagaataacctcattggagaatgaatgacctgtgtggggaatttagggtagagttgagattgaaaaaatgggccgaagtcaggtggccaagggccttaataccttgtatacaagatgtgtagtcaaggaagaccatgccttacttatgcatcaattcccttgggcctacaaagagctgcctagcctgggactgttgtagagaaaagctacagtgttccaatgacacagggactcctccatgtatgtatgagtgcccagctggctctgtaataaatcttatttttatttattaacttttcttgcgcattggcttgatgcatcagttggaagtcagaggccaaacgaagtgaacactgagccaaaggaagttctcagcctttagggaggcagaattcactttaaacacaataaacaaatgaactcacattatacaggagagagtcagaagatcccagtggctggtgtcatcgggccatatttgcccgaagtgcctattccttataggaacccactcccagggttgatgggctacatccttaggaggctttatgcctatgttctcctgaccactggctcctccagggctggccttttttagtctctctgtagaggttcctgtagctggttggatataggctttcacagaagggtcagtgccttgggtctggttacaggactgttaatcttgctttgttaagagtaatgttatttccccatttccaaattctccagggagatggaatgtcaaagatagtatgactgtagcacctaaatcctgggttccagaagcagagaagagaatacactgaagctgtagaaaggcctattagtccatgtcagagattaactggatgcgaggaccatttctgggatggtgtatacagaactggagaactggatagggagtcagaaacaaagagctgaagatgatgcctttgaagtttccaacgtggataactaggtcaacagaatattactcaagaaagtattaacataggattgagatgcagtcagtagtaatggaattgaaatttcaaagtatatacctcatggatctcagggggtgttgagctgatcacctgggctaacactcctatgaccctggggaaaatcaaatgacctggtactgtagccatggtaggggtgtcatcaccttaatccaactgggacagtgctgtttgatattcatctggaacttggtgcagacccacattttgctgggtttcaccacaaccaaggcttttttgattcttttctcttttaacatcagtacatcactgcaaagttaatcctcatataataggagatgaaactaattgcttataaaaacaagatttttacaacactaaaattgttcaagcatatgggcatatttatagttgcaggcagtgtttcagatgcagactgttcttggctgcagtggttgtttacaggcagcatctgttctgattaaatatttgatgattatccccgaatgttttaaagcatagtactgggctctgctgactgtacaacaaactggcatttttgacctatagggcactgggctaggagatacagttctgagggaagtgaaagatagttaacaactgcacaactgaccctttattagttgcaataaagcaatccaaccacccaacccactgtgatggctttcctactatttaaggttggtggtgtcaaagagacaccctcctgtacagtgtgcagtgaatcaacatcatttccacaaaacctccttcctgcacaaaggaattatcatactttgttacgaagtaaaattttcctgtatcagtcacaggagttcaccagttaagatactgttagttgaagacttctggggtgacttaatgaaatagctcagccatctggtttaaaaactggattcttctatccctccacacagctgtccatgcacctgcatcatctcaaggctggtctccctggtggtagaaaggctgacagtaaaaactggagccacatgattccttgcttaggcagtgtttcttcatactctcacatgagagcaggcatgttctttccctaggctcacagtaaacactctgtcaaatctcacaggcccaaagtgcttttggttatccccattccaagccaatctgtggcatggaagatagcattaccctgactgccttagactaatatacctactccacttctggggctgggaataattttgaggtcaaccatccaaactgcatgacagccattccatggaagaggtatggcctaaatctttggggcaacctgaattcatgaaaactctcttagatttatgtaactatttttagaattcacttctgtatcatttaattttactaataaaaataccacctttaccctaaatgtcagccaagcgtaaggctccgttgggacagaaggaactatcaaagctttgtgtttttatacattagcagcatttgacaaagaaataactctgaaggaaggagaataaccaggcagagtctagatgcatggaaaagaagtctttgagaaggcttcgcaggctgaaggaaagggcaggactacttcaggaatacaacgtttaagtaaaagaggttggggtctgttgatcttgaggagagatgaggatggactggaaaataggagtgagatatagtaggagaggaaaggatatggatgatgtatatactgtatgggtaaccatcagtcgaccctaagaagataatagttgttaaatggttagctatttaatgaaagaaacctgaacaagtaataatcttgagttgcaaagtggctggagtcacacaacagactaaatttctggtagaacaaatccagcagcttatgtgaaggttaccatgtctgaagctggatagaaaaggtctaacttccaaccaaagtcacagttcttgagctcggtacacagagacagactgctaacagctgatgtgtcctcagcgagagtgtcctcatttatatcctcgttctcttctgcctcctttttttgttttaaacttttgggaagtctcatcattcaatacagttctaatatatcacaataacagaggcggcccaatttctacaaattgactaattctatccctgaaaagttcatacaataaaactatacaaagcatcattttcaaccatcctatagaaaaatttccctattaaattttaactctaaatcctctatctctgttaataaccttactaaaaacttccccatcactgcctgccagggagatcaaaagaaaccaaatttaagaaacctccaacacctgtacctgactgaaaagcaaacatacagacctttcagtcctgcccctactattcagctcctatcacagagacatggtggatgtccccttgggaagcggatagctcttaggtggaagctaggcctgcaataagcaggccaggaaacatgtctcccaggccccatactcttggcagaagcacttggccaccagacagcatgtcctgtcaacctacagagttcttaaaaacaaacactgggacccagaatagtaccctgtggtcatagtgcccacagttcactaagcaccctcacaggtctttgacagaacactgactgccaggtcacctggtgggcagagaaatggaagattcccaggcccaactagcatctcagggaagaaccacaagcagagcaactttcagagctggtcggccagcgttggcacccagggaagcaagtgctattccatatttggagagaacataaaactcaaggaaacagagaagtcctactcaataccgttctcaactgaaaacaagagaacttgcaaaaaagaaacccagttttctggagtccatggagaaatatgaagccaatgctcggctaacagagcagaaagccttttataaataatgccagtcaaagctccaaaggtcagagctgatgcatgccggattgttctgacaatttcttaggtttctaggcaacaaggagctggtcaaacagctcacctccaaggacatactttataataccaccctggtagacgagagcgaggcagcagtgaaggcaatagtcaagaacaggagagggaggtaaagaacaagatgctcttcagacagtctggacaaagacagtccctacccagctctcaggagttgcctccttaagaaggtggaggcccaggcagctcccagggtgaccctaaagacagactccaaggaaaagggtgtgagggcaatggtgaatataaggaggtcccctttcagtaggcagagcaagtcagttcaggtcttatttttagagtctctgaacagtgaagagaagctttctgtggacagcattccaccaccatgggaggggaaaggtgccatgagagacttctccagtggggcatacaagcattgtgcagtgatccccaagatccagccactggcaggaaatcgaaaggcaagcttcttaaatacatagtatatggagacagaagtgtggagcactcccaaaatgaaaggccaagacccaggaacaacctccacaacctggagtatatacaaatgaacccagccctgctgactcagatccacaccatcctaaagcaggggtttctcatgaatgaaagggctaagtatttggtggagagaatgagaagtctcccactgcccacacattttttcttcagagatttcttttccaagagccccttgaataaaggaagggagggagcactgaatgccccagaaatcagaatgcatggtgcgggaagacgacaggaaatagttctcaaagagatcagaaaataaattggaagcaatttcattaccacaaagaacagacattttttctaaggcacccctcccctttccacccaattgtcattcagcaactactgaatacttaccaatgaaaaacgttacccctgacctcaaggctgctcctgagctctggtagaaaatgctttccttgtctataaaacatggcaagcaaggcaggatttaacagtaagggcacagtagcactgcaagccttcaaatggaaacctggagacaagcagtgagaacaggaagcaaaagcagggcaggtgaagctaggaccagggcatctggaactttccacacaggttggatctccatgccagacaacagttttcaaggaaaaatatctaagaggaacatgactttgggaaactttttggcagtactgcttactgtatactagagagtaaaagaatttggggaacattcaccaatttgcttcttcaggggcttgggtagggaacgtgaacaggaacctggctctaatttctgaacttttttatcagtaaaaacaatccaacaaacgaaagctagtcagtgagagaactgggagggtctgccctccttccctgagtcaagccttctggggggacctcctgacatttaattaagcaaagacaacgcccactgaaggaagctgacctgaaagtgacacgctactgtgaaatgagcatgaagtgggagcttgttacatatatgaaatggccagcgatcctgagcaaagcgcttcagagcttgagacctaagtcttctcatctatatactgagggctggacaagatgatctgtcaagccatttttatccctaatccaccaaaatccaatgctttagtttattgtcacaaaagcaggtatcgaatggctatcctgcagtgcctccaatcaacattcagactttttccctgaggcaatataagataacagttaacatgtttttatcaattaggtggtcatgagataaatatatatgggaagtggtagtttttcacttaaatgcatataataatggtacagctctctttgaatagtatttgtttatttcttaaatatttaagttcctaaagacggtaagaataacccaaggaagtgaaatcaatgtcacaaagcacatggctaaataactgcaggtttgcagtgccatgtgtgagatcagatgacagaagggagaactacctttaggcagaggcttctcatgtcccctggagtggccatgtgctgttctacatgactacttccacttcggttatgtagaagctatttaaagcacacagatgtttgtgatgagaaaaaagccacccttaattgaataatggaaattataagcatgatttgagggtgggggtggaggtgggagtagagatgggtagaaaggagtgcaatggaaacaaaggagccttcataaaattcaagtcacttcttaggataacgtgattgatttactcaccaccttcttaggaacataaagcaaacaagtgggttttccttttactgcttttctgaaatgagctacactcaagaaagcagcacgggggttgtgctgtccctgcacagtggcaggagagtatgaggagcaggtgaatgccacaacagctccatccaagatcatttttcacatgcaggaaccattcttatactaccctttactggtaatttctgtagaaatctggaagtctggttgacaccctcctgtacagtgtgcagtgaatcaacatcatttcccttggactttgcaatcacggtggcattcatacattcattcaacaagtatgtatgtacaggacagtggagtaaagaaaacagatagttcttactctcacgaggcttaaaatttcaggagggaactaggcagtcatgaagtaaacataaaaacacagattgtaataggcactagagaataatgaagactttggggaacacaatttaaattggaaaaatatctcagttccgttaacacatgttgaaggggaatagcattgttttgctggatttggggcctggatgcaagcatgttgggtatgcattgtagggtaatgcatttccttccatttgggcccaagtgtatatttaccacccagttgtgatgagctgggatcctcctgctcaatctcagcttgaagcacttggaggttatctgcctgctgtgggtgattattttggagcaaggtacttcatttgcctcaagaaacagatttgataccactactgtgcccttttggaacagagaagtaggcaagaccccagtgtgaggcagagtgatgggatctttagggacataattgatgatgtaactgatgatgattttggagtttatacatttccaaagtttcaaaatattttcacttggttgatttatctttatggtgatgacactacgtagatatatgcccttcttaaaagttacagtaagaggctgggagcggtggctcacgcctataatcccagcactttggaaggccgaggtgggcagatcatgaggtcaggagattgagaccattctggctaacacggtgaaactccgtctctactaaaaatacaaaaaaattagccgggcgtggtggcgggcgcctgtagtcccagctactcaggaagctgaggcaggagaatggcgtgaacccgggaggcggagcttgcagtgagctgagattccgccactgcactccagccagggcaatgagcgagactccgtctcaaaaaaaaaaaaaaaaaaaaaaaaaaagttacagtgagagttgacattgagaaaagggaggcccagccagggttatgcaaagacacagtagggaggaggatgggaagtttctgagacaccccagtaactgcatgggtccacaaagcacatgtacagtctgctctatgcactgcaggtacagccacgaataagacaaagtctctgccctcatggagcttggtgtctgtctactggagcagacaaaaacaaacctgctttttctcatttgcctctactgtgggttccgtgtataactctcaaatgctagcatttccatgcattccatccttgtccttctctcctctctgccttttccaggagaattttcctagccacaggttcagctatggtctatgtgctggagtcatacatttttatcttctgtgtacgtttttctctagacccatatttttaattgccttaggacagctctccctggatatccctcagacacaactaaaacatcattcaattgtactattaataattttcccttcaaaatccactcctcttctctatagacctaacagcaacactgtccgtccagctctcaaaacctgaaatgtgggagttgtctttgactcttatctttcccatgcatgagcactgaatcaatcagagtccctagcatgtcttggactgtggcctcccttctatcttcagattatctgcctttttagaattatggcaataacttaactgcaaagaccacatgtgcacttgtgctctttcagtttgtaataaatataaaatgaaaagtgattatgtctttgcttaacgtctgcaaaataaaagtccaaagtccttggtatggtctataaggccctcattatctgacctgcctgccttcccaatctcatcttaatcccttacagcctgacactcagacatactagactttccacctaactcactcacatacacctatcctgtatgtcaagattcggcttgaccttcatcacctacctatctgcagtatttttggatctgaattctctgcccacattgtactttcacatacttcttttacccttagtggtttgtacttatgcctggtctaactagattgtctccctgtaacagacttcttgattcaacaaagcagctctgaatcagcctgaaacctatggcacactgcaaaatggcaaacattcaataggtatttgcccagtaaatgttaatgaaaggaaaaaaattcaaacttcagttggaataggattagagacaagttaaaaaaaagtttcccatagaaatcttcctcatcgtaaatatcatcatcctaaatgtcccgagtctttccatgggtctaatttaccaaatcatgaagactctctttctcactgtgtatgtgtagtgggagaggcagagacagaacggtttttttttttttttgcaagtctgctctctggattcgtttttctggggatgaaatctcaggctatgtagcttttctggtccctttttggtaatcaacaaatcatcagtttctctaggtattaaaaagcctacacttttgaaacaccaagaggccaaactctctcttaattgaaaacataattctgcctcttactgaggtctttgggtgggaagcttaaagacagcagtgttggggcaattggtttttcttttcctccctccaccttctttcccattcaagagctgttgctgccctttctggaggggagggaattagaaaaaaagatcctgccttacccagtcactgttaattattactttgagccagggtggggaatgactttctttcctggaatacaccctgctggaaaccacagctgagattctctaagctggcagcttccaacctctcctccctcaacagcttcaacattatatggcactcagctgcagggtgcctggctccaggccggcagtccatttgtgcagggtagttttcaagatggctcatagcccatctctttcagtgaccagcgtggcctatgggaaacatacatcttgactccattattggtaggagtactctttagttaactgccacaggccagttcagacacgtcttaccctgagagccttttcagagtcaggtaccatccctgtgtcccccagcatctgaagatcacaggtgaaggtctccaagtagttcacttaaaaaatacctcagtaggtttaagaacagggaaagctcccaattcattctgtcaggagtatgactctcatccccaaactggacagatatataatatgaaaactacagaccaatattccttatgaatatagatgcaaacattctaaacaaaatactagcaaaccaaatccagcagcatagaacaaggtttatgtagcatggacaactgagattatcccaggaatgcaaagttaattcaatatacaaaagtccattaatacaacatattaataaaggacaaaacaacatgaaaatcttgatacagaagaagcatttaacaaaacccacagcccctcctttttttttttttgattaaaaaacactcagtaaactaggtttaataaaagaatttcctcaacttgaagcaaacccacagctagctaacatcatactcaatggtgaaagactgaatgctttccccttaaaatcaggaacaagaaaaagatgtctgctcttgtcacttctatccaatattgtactggaggtgctagccagcacactaaggcaagaaaatgaaataataggaatctagactggaaaggaagaagtaaaagtatttctgttcacagatgcatgatctcatatgcaaaaaatactaagtgacaaaaaaagaattttagaaaagctacaatatacaaaatcaatatacaaaaattaattttatttctaacaccagtgatgaatacaaaaataaaaattagaaaataatcatataattaaagtggcatcagtaaaatacttagaaaaaaattaaagacgtcaagacttgcacactgaaatctctaaaacatcactgaaataaagacctaagcaaatgcaaagacatcccacagtcatggaacagaaaacctaacaccattaaaatagcagttatttctcaaatttatctaccaattcaactaaatccctatcaagatcccagctgttttgcaggaattgacacaatgatcatataaaaattcatatgcaatgcaagggacccaaaacagacaaaatgattttggggaaaaaaaaaaaaaaaatggaggacttgcacatcccaaatctaaacttactaccaagctacagccatcaagacagtgcggtgctggtataacgacagacatatagggcaatggagtaagactgagaatccagaaagtcttatatttatggtcaactgttctttgacaagggtaccaggaccattcatggggaaataatagtcttttcaacaactggtgcttgggcagatggatatacagataccaatgcacttatgcaaaaaatggatgaaataggaaacttcactacattctactgcatgctcggtcattttcaatcatttaggtggcaacactgacaagataacagaaagatggaggtaataacatgtgaaaggcaaaatggtttgtttttttttttaaaaatgacagtctctatcatgaatttacttacactccaggcaaaggttattagaagaaaaaaagatgtaagaaaattccttaactgaaatgtggaaagagtatcaagaggagaccctaagacactctgtaagaatcccagtgactcctcactgttcaactaagaaatgtaccccattatgctgtgctaccacggaagcattggaggcactttgggggttgatgaagtcttcatggatgaggtactttaaatatctggtcatgaagagtatttgagaaatatgacaagtgaagatgctgggtaggaatgcagcgaggaaagtgtgtaacacaaggccaaattggaaaggtcagtgagggggcaatctgtggaggcactgaatgcagaggatattaaaattagcaagatagtgttctagcacaatgaaaaggattggaagagggagatgagagtcagggagtgaaattaggcagctgctaagaatgtccgggtgagtcagaggatcaggacctgtaagggcagtataaagaaggaaggaatgatgggagaggtttagggggaaagaagtgacaacctgtgacaattgaggaatgagagattttgatgattggggtgaaggttacatttcttaaaaagaaacaaagaatggtcggtcgatagagatgcaagatgaagaattttgtttttaggactactgactatgaggtaacaaagaaatcccagagacagaggtctgagcaaaagatatgggattggggaagaatctttgggagtgactgaggttgactagagggaactgggcaagaacaggtaaggactttaagcagaattggaggagtatccatctaaaatctgggtaaactgggatggaaaaacaagtagccagagaagcaacagcccaagctagggtgttgtcaaggttatagatgttactgattttggcaatgaggagattataaggatccttgaagactgtactttcggtgaaactaccatgcattagtagcctttcacagtgatatctaccccacacctgcatcaaaatcttgcagtgcctattaataaatgccaacccactaacggggaggggagaaaagacttgggactctgtacttgtaaaaccctctaccctccccaggcaattctttacacactaacactgttgaggtaaaaggagacaagtgagggagcaaatggaaggtgtgtttttggattatacagtggctcatggaagggtgggaggggtacagatggcccttagacactggcggaaagtcagagaaaaaaaattacagtaagcaggtaaagggatcaagactacacagggactagtcttgggacgacatttcttcctctgacagtttgtatggaattcttgagaaaaattcctcgaaggggcctgaaatctcagaatggtcatgtttttaatgggaatagggagtgatgctgccccattacaaccatctgttctaacagaatgtctgtaccgaggagggatgagtaacatcggcaagttctgttcgaagcctttttcaagtttctttttgatatgtatctatctatctatcatctccctatacaagcaagcatccccaaaagtagttgtctcaggaaaccagggttaggatgaccagctcatttgctggagctgccaaggtccagaaaagtttggctgcaggctgttttcatgttttatgtatgtttgaaatgttctataataataaaaggttaaaaaagtttacatttatttggaaaaccagttactttagtttatggttcctttttttccctccagagcttcctggagattgaggtctaattcaaagaaaaccaaaatatataatagagtacctgggcaaaaaaagtacttttataacataacatttggggtagaggaagtatccactgtagtcaaaatgtctatgttttgctcttccttattgttcagggacattccattaaatagtaatgaaaaggcagcaaaagtaagaggagtgacaacatgcccggcataattaagcaagctagagcagctattctgtgcaaccgacgattttttttctctaaaattttaagggtaggttcattctgactctgttaaaagtctacttgatgtgaacaactctatatctgataacctatttcaattaccactttaaaacttgtcatatggatacgttattacaattgtagaactttaataaataccataataataaaacttgagaactgaagagcacacatttcttcacgaatttattatataaaacgccctcagagtatttaatttctcctcactttaattacacattaagaagcacagtggatgagaagcctttaagatgactacagttgcacgaaggtccctttcatcaaggtagcgtatgtaccctaacagtgttctaaaggctggcccagaaaaaccccatgttaccttatcacaatatggaaagcattgtcttctttttccactaaattaaattatggtgaaaagtgccacagttttatttagcattatggtacataacaaacagttctgtctcaattatgaaaaaaattaattaaaataatcctgaaagacatcctttttctccccccaatgatttgaaagctgcatttttcctgccaatttcaaacaaacaaatcatcaggttgatctacagtaatcagttaaaacaatcagtcaatcaatcaatcaatcaccaaggcacaagctcagcacattagctatagcttgtagcaaaaggatatatcaatgtctcaccttagttaaaaatacataatccttttattttataatgcaataaaagaaattaacaacatcacatacacagaagactaggaaaggggaaactacttacttctggaaatcagtaatgtaaacctacttgtacttttccatagtacatgaaagtaacgtttaacatgttttgaattaattaattaaatttaatctgtggggctatacaatgtaattcttaggagtaatagtttcattcatttccaggtcagcttactgtatgattaagtaacacaaggcacagtagccatctttttcattatgttgcaacactgatcacgtgcctcgataaaatggctgattcaacaagatgatggcaacacgaaggggagactttggattgtctatttaaaatctaggtaataagtaagtaattaataaaaactctatcttaagtgcactttcacatgctttttgtttataataaacaaacaacaaacttcctaactttgttgcaataggcttgactaccatttcatttggccaaatgcactttccccagtaaacttaaaacaacaacgagaacaacaagaacaaaaatccctgtcctttcatatactaagaaagaggattggctactgaaacagttcattgcaagacacatgaagacgacatactgtggcatgagttgtttttgtttttaatttgttgtgctgttactaaagttctgagggctgcagttaaaacattccaatttctcccttccttccatctttctttattgattgattctcaagattttgcacagaaaactctttgggggctagaacagcagtaattgcatcacactgttttcaagacttcaagtttcaaaagcaaatcattaaaaaaaatacagttcctgatttgagttagatacagggacaaaaaagtagcacatacttgaaggttacgtggtctacaaatggtggcaatattttccttgggagagtagttctgttggtatatattttttaaatactcaaaaggctcaacctcaagcagtaataaacacaagcaaaagtgatttaacccttaaaataaatattcagaaaaacctctctgtacatacaagtgaaagaatatgtaacactttcacgcaaaaaaataattataataataataaaggatttgttcatatatgtagctgaaatctgctgttccagcccacatgtccccaataaagaagggaggcacagacataggtgactactgtggttgactatcttacagcctttttgtactgggacactatcaccaccaaaaatttatccctcgttatatttttaaaattttttaaattttttctttttttttccttccttttttttgttttattttgttttgttttgttttacagcatgccaaatcctttggcatacgtgatggccttcaacaatctctctttaagtttttctttgcttgagtattccggaagtaaaagcacattaaagcaagtatgagatgtaggtaacctaaatagagaaaaggggaaaaaaacaggaaaactgtaagtcatgggaaatacacttagaattaaatgctcctatttttagattgtatatagttgagacggtctgcaatgcaaactatacattaatgcaaatcataaactttttgttgtgtaactaccaagttgcctttatcctataaattactcaaagctagtgacgatgataagatactgtatccattgagtttttactacataacagataccattttaggtactgaattcttacagttcatttaactaaatctttccacaacaaaaccacagagaggacatcagtaaatgcactttagaggttaggtcactgagaagtcaagtaacttcctctaaggtggagaaaatactcaaacctgttttacaagactgcaaagtgtgtgctcttaaatgcttattagaaacactgctggcaatatgactaagaaaatgatttgataacaggattctagcacaatcaaatgataatcttccgagcctcaatgtaaccattctaaatagatgatcatgttatatggctttcaattaacaagctgggaatcaaaaaagtaaatgaatcacactaatttgattccaaaccaatgtgagccccataataatttttaactagggcaatttcttaaaagtttcctcacacaatgacagcaaagtattttctcaattgtctaatatgatttggggatttgtatataaaatcacgaatgtgctcagaaactataaagacagttcatatgtatgtgacgaggaatgcaaggttttcggtaggtatacagtcacaagttaataattacctacctttctgtgtctgggccatttttggctataatcatctttaattttcctagtcctcccacaggtgctctgtctgtgcccgttgtaaactgcaagaagagtcttttctgttcatctgtaaatgaatgaacgatttcccagaactccctaatgagaaaaaatacaatactggtttcagtttggcattcattatgactggtactaacataagcttatgatttgcattaaaactatattaagagacaacttggaagttaattatcaggatagtatcacttctggtgatttaaaaatttccaagcaaatttatcctgaacagctctgaatacgtaaaaatttagattagattacaatatagtaaaatattagtactacaatagtaaaaaattgagaaaacccaagtgtgtagtaacaggaagtgactatttaaactatggtataatcacattatgcagtcagtaatgagcaaaagacaaaatcctatgaattgaaaaagactgaaatgaatatttggaaaaattaactccaggtgcctttgggtatatattttatttatcctttctcctttattctcctggtctactcatcctttaactcaactttgggaggaaaaagtgatacagattaaggacaaaagaaaaaaagaccccctgccccaaccaactggccccaaatgcaaacaactacatacctaatagcagtaatacaaaagttcaatttttatatgaactagaatactttaaacaagtaatatgtgctgtgtatggaggaggagaattattctgacatttctgccacctgcagttattttaagagaatgatttatcctgtggcattcctaaaatctatgtaataaaagctatgttttaatgacacttatgttagtttgagttctaaaaaacgaaatacaagctcataaagtgcaatcttgaagtttatttgaataatcaggcatctataaaacatatatacactagttcatagctaaataaatttttttttttttgagacagagtcttgctctgtcgctcaggctggagtgcagtggcgcgatctcggctcattgcaagctccgcctcctgggttcgcgccattgtcctgcctcagcctcccaagtggctgggactataggtgcctgccaccacgcctggctaattttctgtacgtttaagtagaggcaggatttcaccatgttagccaggatgggtctcgatctcctgacctcgtgatccgcccaccttggcctcccaaagtgctgggattgcaggcatgagccaccgcgcctggcctatagctaaataatgttaagattaaaaaattaaaaaaaaaattaaaagtatttttagttgcttatataatataaaatgcattttaatagttatttagaaagttctttccagagccaggtgtggtggctcatgcctgtaatcccagcactttgggaggctgaggccagtggatcacctgaggtcaggggttcaagatcagcctgaccaacgtggtgaaaccctgtctctactaaaatacaaaaattagccgggcgtggtggcagatgcctgtaatctcagctacttgggaggccaaggcagaagaattgcttgaacatgggaggcggaggctgcaatgagctgagatcacaccattgcactctagcctgggaaacattttgagccatctcaaaaaaaaaaaaaaatttcatctcaaaaaaaaaaaaaaaaaaaattccagaatgttagcagagaacatcacacatcccaaaccagtaattacaattttctaccttttgatattctaatatcccaacatactatttttattaccaaaatgctggcatttttggtgctgcaacaccatttatctgaaataacttaaaagttttattagaattcttggctttctccaatctcttgccacttcccttccctgcccctttacaaatccaccagtcagcaagagaaaacaaaaaagaaacacacaacaacagaaaactggacatgaaacttgcaggagcatctctcaggtaaggaggagaggaatcggaccccagttcatgatactccttttggggaggctgacaagagaaaacaagtctgctgtagcacagaaccctccaacatagcagaaaagctgccctgcagtgggtggtaataaagcctcctcacactgcaggagggctctgaagcttaactgaaccagctacacctaaggaggtagaccaaagagcaccaccgaagaacagagacagaccctgcaggaagtggcagatcagcagtggtcacaatgaccagtctggctatattattacggagctgtttctttggacttttaaacgaaacctttaaaaattttatacaatgaaaacagggaacaaaatgcatctctattcctataagtgttatgtgtgttacattaacattttgaattaaacaagaatgcatatatttagaaagctgaagaaaacacgaagaagcttccaggtttccacataaaagtggtggctgtatcgatcacatcctactcacatctctaaaaatctacccggatcaaaaaggggaaaataaaaaaaaaacctatgacttaggtctagagtaaaactaggagacagaacaataaactccaaataccaaagaagtggggaaatgagcagggtccagcaggagctacatcgaagagtggcttgtgcggaatcatactgattagggatcacccaaggccagaccccaccccctccaccacctgcccctcaacagagcactactgagtgtaggttagagcactggcaacagggtggttaaaggaaggactacagaaaagtacttgggtccagcaatggcaggctcaggaaggcaccatgcatgaaaggaaggggggtaccttcaaaagcagaagtgtcccttaagcggctgtaaaggggtggaagcagctaatgaaaaagagtcttcattaagctacatggagctgaaaaatcagaaagtggtgattctgcccttactaaagcaacagaagagggatcccttcaaccaagacccctaaagccacacaattcctccctgctccaccatgaggtctagtaataacaggtccagaaaaaagtaacatctgttatagaaacataaacaagaaaaacagaattcggaagtctaaataaagttattatgggaagagtctggcgaatgagaagcaaaactttccggtagacaaaagtagaccagaaaaattcagtcataaacaatgggaaactagtaacaccacattccaacacaaaaggagaatgcagcagcagacaagacagaccaccagtgatgagaaatacaaattcagaaagaaatgagcacatcttaaataaaaataagaatactaaaaaatactgaagaaatatgcaaggtaactttggaaataaaggctaattttattataaggtgaccaaagaagaagcagtatgactaaaatttctactgaggacagactctagaaaattaaaaaacaaagaaaatgaataaaataaacataactaaagaaatgcatatcaaagcataataacgaaaaagattaatagctaactacataaacataaaacctttcatttggcaaaaaaatcctataagcaaggttaaaagacaaatgacaaactgggaaaaaatatttgcgaatttaccagcgttaaaggactaatctccttaacatataaagtttctaaaagtgaagaaaacgaccagctgagcagcaaaatgagcaaaagactatataaaactataaacagctctacaagaaaaaatgtccattatcattcataattgaggtaagctcaaaaattgtaactatagtaaaataccatttctcaattggcaaataagtaaacatccacatttaacaacacattctgtttggaaagttttaagaaaagagatactgttgtaaactgctggtgggaatgcaaaatgttatttttctgtgaaggaggatttggcagtatctagcaaaattacacatgcatctaccatttgatgcaacaatcccacttctaacaatttatcttaatgatactttacatatgtacggaataatgcatgaacattaagaggattcactgtgacattagtactaacagcaaaaggttaaaaataacctcgatgcccataaatattgataagctatgctgcatccacacaaaggagcagtattcagtcatacaaaacaaaatggaaaacacctctgcaataatgtgggatgattctcaggatacactaggaagattattttcctagttctgtcctctgataaggcctacaagcagtaacgttcaaaagcaaaggccatactttgcatctaaaatctgacttctaaatgccattctccaacaatttattggaaaaataacttattccaggcctgagaatgaatgttcgagattagttagaaatctcaaaatctaatagggtcattttaaaagcacacgatagctaagcaatttgaatatcatttagagtaatgactgtgaaacgtattaaatacaaaaacattcattagttcgtaatattcaaaaaggcagcaaaaaccaaccaaaaaacaaaattaaattgtcactattaaaattattacattaactccttactctaaaaaccttaaatctattttatcatgccttttctgtagaactgtttttcaaggtaatcaaatggcacccaatgatgagaaaaaagaatgccaggtatatatgtaggacaagcagatggaaattttttttccccaaacagccattttgcaatccccaatgagataacagattaaggtaatgatactgataaatacgaaaatcaggtgaagggcaggtagcaggttctggaaagatgatgatggcaacgacatagttattattattattattttttgttttattccctcccaacctcccctacaaaaacagcaaactgaatgagaaaaccaaagacccagagacattatctacaacaaaaccatgaaccattgcatataattggacagaaacaaagctctgacaactacaagactggttagtaaggaagcagatgcaaggtaactgactgggtttctgacagccctgagaacactgccaacccactggaaagcacaggccaatctgaaaacagggcttaaagttttaaaaagttctacaggatctaatttgcagatgattacaaagggatcatgatgtagtaagctctgggcccttaaaacacccgaataccaaacccccaccagaaacaaaccttgtaccgaggaaaaacttctgggaataacttccgaatggaccaggtcagtaataaaaaccaaaaaaaagttcaaatatatgtgtgggatagaggagtaaagaaggcagtttcagaaagcacaagggcatatttttgaccattttacaaaaacacagacttctcctcgtccctaaaaagcgaaaaaagttatcctggcccatctctccctcgtccaagtatgagaaactcatttcactcacacacacacacacacacacacaaataaataaataacagaacagagtgaaacagtgtaattattagagaaaaagtatgtgcatatacatgagaatggtgtccctacagaaaatcaaagtacatgaaacaatatgcaaataaaacatgaaaactgtaaacaaatttcaaactgagctaaaaagaatttaaaaaataacaaatcattagaaatgggaaatttctgaatgagggtaactgaaaaaaaggaagacatgacacaactaaggagtaattagaaatgcaaggaaaaaaatcccatcaaatacaaagaaactaaaactaaactagaagaaacataaaggtgaataaaacagaacaataataccagaacctgaaggcagaagaaaaatcttaaaatcaaaaagaaacaaacccatgcttgagactctccttgctggtccagagccacagtgctgctgtgtactggcaggaggaattctgctataattggtcctggcagtgttcacctttcctgcaagtgttccacagcccagggacacaatgtggtcaggagcactgccaggaacaccagcaagggggagcctgccacaacaggcacaaggctcaggaagcactctccagcccacgaaaatctagtgggggtcctcttccctcacccaaacacactctgcgcagctcagcctggagaaggcccctcaagcagcactactaggaaccagtgcgagccccagtggactgagataaaagcaacaaaccaaaacagcaccataaagcctctgaaaaatggtcactggaaccacagctcacaaatatatgctagtacctacatgctataccttaacaggttactactgaagttaaaatttttaaaaagtacagagtctcctgatataataactaaaatgtccgagacacaatccaaaaattatctgtcataccaagaaccaggaaaattacatgaaggaaagaaaacgccaacactgggatgagtaagatgctgaaattatctggcaaggatcttaatgctgccatcagagaaatgatttgacaagcaattacaagttctactgtttcaaaaacgaaacaatagaaaatctcagcaaggaaacaagatacaaggaaaaaaaagcaaatggaaattatagacctaaaaaatacaataggagaaaaataatcattagatgggctcaacagtagagtgaagatgacaaaggagagaaatctgaacaaaagagagaaaatagactgaaaaatgaaccatgcctcaggtccatgtggaacagtaacaaatgactcaacatttgtatcattagaggcctagaatggagaaaagagtgacgctgaaagaacacctgaagaaataatggttgaaaattttccatgtttggcaaaagacacaaacttacagcttcaagaagctgagcgaaccccaaatagcacaaataaaactattctttgggaataaagggaaaataaagtcatcttcagaaagagaaaaacaaaaagaatttctcactagcagaactgcctttgaagactggctaatggaagtaataaaagatggaatcttggaaaaaataatggaaatagcagaaacatgggtacatacaacagagcatcactcccttgataagttctataagtcatattggataactgatacaaaaactgtaatagcattaatcctcaaaacaatactatttaaaagtggggaaagagacccaactgaaattaaggtttccatatctcattccatgtaatggtattgatggcagtgaatggtggtaagtcacattatctataatgtgatacccacaatgaccgtgaaaacaactataaaaaacacatagaaggccaggcatggtggctcatgcctgtaattccagcactttgggaggctgaggtggacagatcacaaggtcaagagttcgagaccagcctggccaatatggtgaaacctcatctctaataaaaatacaaaaattagccaggtgtggtggcatgtgcctgtagtcccagctacccaggaggctgaggcgggaggattgcttgaacctgggaagccgatgttgcagtgagctgagattgtgccactgcactccagcctgggcaacagagcgagactgtgtctcgaaacaaaaacaaacaaacaaacaaaacaaaacccaaacactaaataaatcaagggtcttaaaaatcttaaaaaatgttcaagtaatcatggaaggcaataaataaataaccataaacagaagacagaaacagaaaacaaataataaaatggcagacctctccctaacatatcaataattaccttaaatataaatggtctaaataaaaaaattaaaaggcagagactaacagtttttattaaaatgacaactatatgctgtttacaagagattcgtttcaaattcagcaacacaggatgaaagtaaaatgatagtaaaagacagatcatgcaaacattaatttaaaaaaaaacaaatggttacactcatatcagattcagagcaaagaaaatcgcaaaacagaaaaaacttatataatgataaaggaccaatcaccaagacatagtaattctaaatgggtatgaaccaaatgatagagcctcaaaataaatgaaacaaaacctgataaacagataaatctcagaagcagacctatataaatattctcaagtgatttttaacgtatgtgaaaaaaacaattcaatgaaggaagaacatacctagaaaatacataaggaacccttaaaactcaacagtaaaaaaccaaatggactcttggtttttaatcccagagaaatacaaactttttgtttacaagtaacatcacagttaatggtaaatattatagtctctctcaataaaatgaggaataaagtaagaataccttctaccaaaggttctagccagtgcaatagaggaacagtaataaataacataaacattggaaagaaagaaacctgtcttgatttgtagatgacatagctgtttactagaaaaccctatgaaatctactaaataactactagaataagtcaatttagaaaggttataggatataagatcaatatataaaaatcgattttatttcaagatagtaataaacaagtgaaaagcagtatttaaaaaataccactaatagcattagaaacatattttaagtttattcctaaccaaagagtacatgatttcaacattaaaaactataaaacagtgctgagataaactaacaaacatctaaataaatggagagacgtacggtgttcaaggattggaagaatatattgttaaaatgtgaattctctccaaattgacctgccccagtcaaggcaacccaaatcaaaatctctgcaggctttgcccttttgtttgtaaaaattaactgattctaatatttatatgcaaataaaagtcaaagcaacctaatgaaaaagttgtgggactcacagcatctgatttgaagctgcagtaaccataacagtgtcattttggcaaaaggacaaaacaaattaatagaacagaatggagaatccagaaacacggctcacacacagattgattttcaacaaaggtgcaaaggcaattcaatggggaaagaaaagtctctttaacaaatggtactggaacaaataaataaaactatttagaaaatgaatgacatccactgtctaacagcatcacaaaattttattggtggtggatcacagatttacacataaaagttaaacctatattacacaattagaagaaaacataagatatttgtggctttgggctaggcaaagatataaaaggacataaaaaaccataaaagaaaaaataaattagacctcaaaaaatgaataatttctgctcaccagaagacacttaagaaaatgaaaacttggagaaaataatcataaactacttatcagaaatgggccttttatatagaatatacagtattccccacttacccatggggaatacgttccaagacctccagtgatgtctgaaattgcaaatagtactgaaccctgtatatactatgcatgatttatttttccttcttcacaatttcatagatacaatactcatttttaccatagattttagcaacctcaacatatgatttttaaattctttccttaaaggaagcactttccagcttctctttggcatatatattcgaatttccaacatcactgctcttgtgctttagggccattattaagtaaaataagggttacttgaacacaagcatgtgatactgcaacagtcgatctgataaccagtagactaaaagtggtgggtagtctagacaacaacgatatactggaaaaagggataattcatgccctgggtggaaaggtgggagatttcaccatgttactcagaatagcatgtaatttaaaacttaagagttgttggctgggtgcagtggctcacgcctgtaatcccagcactttggaaggctgaagtggaagaattgctagagtccaggggtttgaaaccagcctgggcaacatagtgagaccctgtttctacaaaaaaataaccaactaaaaattagctgcacacctgtagtaccagctactcagagggctgacgtaagaagattgcatgagcccagatactcagaggactgaggtaagaagattgcatgagcccaggagtttcagtttataacaatctgtagtcatgctactgcactccagcctggatgacagagactttgtctctttaaaaaaaaaaaaaccaacgaaccaaccaaccaactctccctgccctgcacccgccaacacacacatacatcaaaaaccctgaattattcatggaattttctacttaataaatatttttggaccactgctgaccaaagataactgaaaccaaaaaaaagcaaaactaaggataagacatactgctatattttaagaaaatatctatagtcaatagaaatacaaaaatccaatattaaaaatgaggaaaagacacttttagttaaatatgcacctgctatatgctttggaaactccactcctacatgtttgcccaggagaaataaaacatttccacaataagactacacagctttattcacaatagtcccaaactggaaacaatccaactgtccaccaacaggtaaaaaaaaaacactttgcgtattcatataatgcaacactactctataattttttaaaaggcactataaatcaatgcaataacatggatgaatctaaagagtcttcatgcagtacaagtacataagattccattcataagaaattctagagcagacaaaagtaagctacagtgacagtaattaggacagttattgtctgttctaatgggggatggagattcactggaagggaaaacatgggaactctgtgctgatggacatagtctacaccttgactgaaatatggttacataaatgtaatttttaaaaactaacccaattaagccctgggtatttcactgtattcaaattttaccccacacaacatcgacaccaccattattaccaccacattgataacattcagagagcagttagggaatcacattattttgaaaattagtaagtaatgggaaagaattaagcattatcgtatatgatatgtacatatttatatacatgtatacagatcctatatgtggatctgtaatttagggtagtcatagagttgatgagaaagagtttttcttaagaagtattacaggtaataaaggaaggaggaataaagaattcgagtatcacaattttgtaaccctcaatgaattagcagatctaggcaatcagaatccacgataaaaattactagaaaagacagaaagcgagtgagacttttaagttattcctacaaaccaacatctatgaagtatttgggaaggaaataaactctgaatctgtttttcgtttttttgagatggaatctcactctgttgcccaggctggagtgcagtggcacgatctaggctcactgcaacctccgcctcccaggttcaagcgattctcctgcctcagcctcccgaggagctgggattacagctgcctgccaccaaacccagctaatttttgtatttttagtagagacggggtttcccccatgtttgccaggctggtctcaaactcctggcttccggtgatctgcccgcctcgggcgtttttgcatgtattttttcaggtgctgaaaaagctctccctgatttcatttcttgttgactgcttagagacatctttccaaatgtccttccttgtcactttttcaaagttaggagcagggattgcacgtttttttgattggtaatttttgtttcaaaggtttgattcagattcagagttgattttgctaggtatggtggctcacgcctgtaatcccagcactttgggaggccgaggcgggcggatcaccagaggtcaggagtttgagaccagcctggccaacatggcaaaacccttatctctactaaaaatacaaacattagccaggtgtagtggtgtgcacctgtaaccccagctactcaggaggctgaggcaggagaatcacttgaacccaggaagcggaggttgcagtgaactgagactgcgccactgcactccagcctcagtgacagagcaagactgtttaaacaaacaaacaaaaaattaacaaaatcttatttctagtggtttacatattaatgatgctggcaacttttagttgaaatgtattaaacagcctcgcagtttttatttttatgaattctgcatacaataaataaataccaaccaaaatatctatacaggcataccccagagatactgccggttcagtttcagaccatggcaaataaagtgattatggcagtaaagtgagtcacacaaatttttttgtttcccagtgcttataaaagttacgtttacattatactgtagtcaagtgtgtaacagcattgtctaaaaataagtacattatcttaatttaaaatcattgctaaaaatgctaatgaagtgagcacattttgttggaaaaatggtgctggtagacctgcttgatgcagggttgccaccaaaaaaactcagtatctgcaaagtgcaataaagtgagatacgcctgtaatgtcttttttctcttctgttattacaagcactactttaagtcttcaactaccgaatacttgtagactatttaatgaattaatattttcatcatatttatattgagaaaattaagaagctgaatttagttagaaaaggtttagaatatcatcaactcttgaggatgagttggaagctactttatctgtcatttttcacataacactagtttgcccttcaaatcatacatttaaaaatgatcttaagatacataccaagtagggattatgttgttataaaaagctagaagtaaaattaagactttaatttcaaagataatttctctataaagaatagcacaagatatgttcaactattctcagagatgcatcaagatatgactttttttcctactagaaattatatctatgatcaatcatattacagagatattgctgttatactccttgtgactgatgaggggggtttttcctatcaccatgttatcccaaccctttaatgaatcacctttgaaactcagaacaggtagcagcacagaggttgctaagagtaaatacattcaccactgctgccagaaatgaccaacggtgcaccagaaagaagaaatactggtgaattcccacataccacgacgaacaaccttataaaataacagaacaaatgaatataaagtaacatacagccatcccttggtatatgtgacagggattggttccaggaccacgtgtgtataccaaaatccatgcacgctcaagttctgcagttggccctgtgaaactggcatgtatgaaagtcagccctctgtatatgcaggttctgagtcccaccaatactgaatctgctcttagttgagaaaaaaaatctgcatgtcagagggcccatgaagttcacagctgtgttgttcaagggtcaactgtaatataaaaataacatttattgctagatagagttgatattcattctagtgtttatatacttgagtcttagagcaatagcctttggagacaacttccaggaaggtacgtgtttgcatgccttctcactgcaatccatcagtagctgccacttgaaccagtcttagcaggggatggggaagcctatgtctttcagaattggatgatgtagtacacagaagtagacagtagagtagtaagggcatttgcttaaaagcagatagaactgggaacctctacatctttctgtgagaattcagggcttagttttttagggtgtaaaatggaaatactagtatgtatctggacatattatcttaagaattaaataaaagactaccatttcactcaaaaagtgcttgatcctgggaagccatgtaacagttcacaaatgcagagttcaaaagaaaggaaaaattgcagacatggtagccttattttaattatcttctaaccagcagtaagcatactctaaccagtgaggaatactagataatccatacgccaaatgcaggagattacatgagacttatatataacaacacttcattcatgaaataaatcacaagattagctctgaaaaatggtgattatattacaaatacaaatctaagtatatagatgacaatttgtgagtttgcttatttgggaattagtacctagagataaaggtctgaagcaaaatcacacacccctttggtgaatcaaatcttcctctgaagaactaagtacctcacctaatcagaacagagtccctggtatagccaccgtcatattctgtagtttcttctagtgcttggaaatctagattctgcaaattcaagaaaatatgtcttagttatctgctatactactgtatcattacaaacaataaatcgatacatgactttttgcagacacctgctttcttacccggcttccacatataagcaattcaatttcttctggtctgaataagtactttaagggagattcattggtcaccatatgaaaacctctccgaaaagccttgaactgtttttctactgatttattgagaatgtagtcagaataaagattgacaaattcctgtagaaaacattaatcacaagaacttcttataatatgctatgcaaacaaaacacaagttattgggctgcatagctttttaatttttccaagaaaaaaacattcaagaatattcttaaaaattcaattttacacctacttcttaacaatttcacaattctctgttatagccaatattaagctatgaaaaggccatatacataaaactgtcaagaatattcttaaaaattcaattttacacctacaaagaaaactacttcttacaatttcacaattctctgttacagccaatattaagctatgaaaaggccatatacacaaaactgtcatacttataaatgtcaatttcgataatgtattaaacagaactgaatataaatgctggagacgcagaaaattctttaggttctctcaactaggtatgtaaacagacacatttaaaccatgtatccatctatttataaatgccaaccgttttaagagagtacaatatatttgatttaagcaaaccaggaagtcccaagttttctaccatagaatatttggtaagctgcctactgtatccagttcagcaaaaatgtggaagtactgactgacacataaactactgtatcaaatcataaaaggaaaatgtgctttgtacccttagtgtgtataatatttaatcaaaaaattatatcaatataaacatgtttcttaaaggtatactatatatttgtcataattttttgcttgttatgttctgggttattcccattcccgatgaacacattttagtcaatagaaacccaaatctgacgtaaagtatacttttcagaaatgtatttttatcacaaacaggatatacatgtgtaaattaaatgtaatttttatttgttctgtgataaagaccttaatcatgaggttcctgcttacagcttaatacaagaaacaccctgcttcttgctttatactacaaccacacttagctattaactatctcctgcttcatgtcctctttctctaaaaggggctttagtgcccaactgtgtgctttcataccaacttatatccaagatttagaaaagtggactctagcatttacataaacttagttacttgttttttttttgtacagactatattagatacttctttaaaaattataagcatacatgctttgaaagtgttaatgaagagacaaaatgtgacataaaaacatttattaccttcctgttttcatttgtaattggaattttatcaccattttcctttagatcatacatcattgggttaccaaaaagatctgtctgtgatatctggaaagtgatcatcatgtcatcttccacattcccttcatactccaataaatcttttaaactctgatatagaacctagcaaccagaaatggtaaattgaggccaccatagaactacaaaatacaacaaataatttatatcactcttcttagaagacaacaaaaatcttatcaataaaaattgtaaaaagtgtagacagtatccctccagtcccccaaatagtttccaacctataaaagaaagattgtcagtcactgtgatgtcccattctctgctgagaaaccccataccaccaatttagcaatagaattcacactgtgctctatgagaaattctgtggtgtctcaaggtgggggtgggggtggtaggagcaggcacactcgttgtaactaccaagacccttagccagggctactctgatttttacctatctcttaagatttcactaaaacacaaacaaaatgtttagaaacacttctctatgaaatcaatcttacaaaagcttcgtgctgacagcaatatataaaaatgtccccctttgagtttttaagtgtttctggtacttcggtcagattaaaacatttttatcttattgataagagtatcaacaaagattctaaacaaaaactttaaaattttgacataaattaaatttttgcatttaaataaaatctaagagactgaattaaaaaaatgacaaagaacttactgggtgagagtctcccaagtcacgaaaagttccttttttccccattagcttcctgtagacaaccatgggaaaatgtacatccagtatacagttattgtaaatagccagacccagtactatgccaatcagagtaaactgaccctcagtttcaaaagaagatggattaaaccaaaacaattttgtagattcatcgtatgtgaacatacctataagaaatgatttttaaaaatacattacttttgtattttattaaggactgatgaataatacaaatataaacttaaaataattatgcatataaaacatttaaaatatatgtaattaggcatgcaacattgatttctattatattagcacttgagaaaacaatgtccacatatatctgctataaattggggtgaatggtgatatgtaattttatgaagccaaaggaataaagtagtaagtaatttggtggcatcgggtagaaaaatacgttaattaaattcaagctttctaattttctactaacacataagaaaagttatattcatgctttatccacccatagctgaaaaataaacataaaaaaacaaaaaatggctacatttccaaagtgtttcatttataaaaatataattacttatatctgtaccacacgtactatttttgaaaacaatttttcatttttttccttgagatggagtctcgctctgttacccagggtgggctggagtggcacgatctcagctcactgcaacctctgcctcctaggttcaaacaattctcctgcctcagcctcctgagtagctaggactacaggtgtgcaccaccacgccagctaatttttgtatttttagtagagaaggggtttcaccatgtttgccaggatggtctcaacctcttgacctcgtgatctgccagcctcagcctcccaaagtgctgggattacaggcgtgagccaccacacctggcctaaaaaacaatttttaatcacagtaaagaaaggttcgttttttcaaaattagacaatggtgccatgaaatttttctagcattttcctaataaaatcagatgatctgaaatacataaacctggataaatctgatgaacttagataaacaaagctattcaatacacatgttaattatgggccaatacgtaaaagaaaagtagtttcgtagtctttcaatttcacatggtcttcactatgcaagccccaatcatggaggcttttttttttttttttttttttgagacggtctcgctctgtcgcccaagctggagtgcagcagcactcagcttagtgcaagctccgcctcccgggttcatgccattctctggcctcagcctccggagtagttgggactacaggcgcctgcgtggaggccttttttatatcactcattggaaaattggggcccggtgtggtagttcacacctgtaatcccagcactttggggaggctgaggcaggcagatcacttgagctcaggagttcaagaccagcctgggcaagatggagaaaccccatctctacaaaaacacaaaaaataagctgggtgtggtagcatgtgcctatagtctcagctacttgagagggtgatgcatggggatggtttgagtcttcagcctgggaggtggaggttgcagtgagccgagacagaaccactacactccagcctgggcctcagagccagatcctgcctccctccaccaaaaaataaaagattaaaaaaaaggaaaattggaatctttggaatgagtactactaaaaattgatttcttcccttttaaatgactaaggaaaaaaattttaattgaatttaaatcattttactacatgtttagttgctactgtgaaacaatgaaaacatcttaagaattaagtctgaaaaaaatctgtaatttccaatagaaaagtagagcttagaaatcagaaatcaaattatacagtatataagtattttaacctgtttataagaattttaaaatctttgaaaatgtcattgtcactttaagtttaaaaataaggagctttaacatgtttccttgatcactaggagtatgaattaagcttaggacattttctgaatgcaaaatggtttgaaaattaaacaattcatatttgagtttcatggtttctatctaaacattttttttacaggccaagttacaacatccatggaaatgcttttagttataagtatggtattaacaggatcaagaacagctgacaaataattacaattaataaatttgttcaagctgacaatggtgtgtctaaaaaattaatgaatttaataaaatgtcacaaatgcccttccttggaaccaagagcaacaagctataagttaatcagaatataactctgaagttccattttaggcacattttctcatgttccagggagaaaagcaccataacctcctggtaaaatactcctttttgatacttctactgccatcacttcagttatcttactggaactgcttaatctatgttttttcttacaagtatttctgcatataatgcaagtatgctttatagctaaggtttaacatttctagatacatcaaaagctagagctaaggtttaccaaatttaagaactttatgaagtttataattttctatctcaaaaagggcgtcgtcttatgtatctctgatttacttagaacaaactacatacaaatggcatagctttttagttattaataaaacactagctagattatagataagggatgcgtgtgtgtgtgtgtgtgtgtgtgtgtgtgtgtgtgtgtgtgtgtgactaagaacagtaacagaaaggtcaactcaattagaatcaacaggctataacagctcaaatctcaaagctgaagggaaatgacatacattattctatgcacactcctcacaattctgatggtaccttcagtggaaaccttttcctgtaattgtcatgtactcaattttaaacgtaagcaagctcagttactaagtggttatatttacagtagaaactgaaccagttcagaattatgaagttaagtagactacccaaaagactgcatcttttccctgttctactttatcacaaaagggaaaaaactaaaattctgatccttcactttcaaatttccaaatcccatcagcctttcccaaactgtgttcaataacaactcttctgttagggcagaaaaagagttctggagttcaaaaagtttgggggaaacactacctatattaagccccaagaaatcttatagcaaataaacctaattaatgtgatatcagctagtgtttctgaactttgagcatgacatacttgtgagacagtctctcaatactcttcaaaccattgttctttgaagttcacaggtcaggaaaaccgtgagtttgatgatggttttagacaacaaaaagcaaagaaatccctccaactgttccaatataccattctaaagtgctttcaattcagtttaccaaagagataatttccttcattagaatattccttctaagaaataaaagaatttgaataaattagtgatacaaatcagttcctaaaacctacaaattcagtcatgatgtgtgattctgggtaatccataccaaatccttcttttgctgctcttcatagctgaaaatatttacaaagtaagataaacaaataactaactcaaaagatgatacgacaccataatcacattactaatgtatttaccaatatctggattgaagatttcctccacaaccagctgaaaaaattctttggaaacacctccctcatcaactccttgttctccttcaaattccacatacaactgcttcttcaagtctgcaggattttccatagcgatcatctctagctagtgattgaaaagataaacatgaaaagaagatgattgctagtatcaggaaaaaaacaaaataaaaacaaggagtaggattaggaaacaaatacaaatttttgactttttgtatgtaaatggaaacagaaagcaaactgataaaaagccagtgaagacaaagattcagtcttaaagataatcaaaaagacagacacaaaacagacactagcatagtaaaaagctaactttactgatttgttatgaaattaacatacaattaattaagattttattacttgtgtgttaagtctggactacacaggacatggaaaagcagctaaatcatttcagcaaaaacaatggagtagaggtctaacctcaaaattgttcattagtagtcctttattagaatagaaactcaagggttaagtcttagtatctactaagtcataagtaaaatatttcaattaagaaaaatacactgaatactaaagcagtttatggtctctcacagtaagacttagtataaattaccaccttttaatggactagaacccatcttatatccacatttccttaaaaacaggtgagacataaccttactcatgtccttactctttttttttttttttttgacatgaaatctcactctgtcgcctaggctggagtgcagtggcgcgatctcagctcactgcaacctccgcctcctgggttcaagcaattctcctgcctcagcctcctgagtagctgggattacaggcaggcgccactacgcctggctaaattttttatttttagtagagatggggtttcactacgtttgccaggatggtcttgaactcctgacctcatgatccgcccacctcagcctctcaaagtgctgggattacaggcgtgagcaactgcacccagcccttattcttaaattgtaagttaacaaactttagtgtctagcattttctcaactataaatcttttaccaaatatttttgtgtacctatagaattatgaatatacagtaacctcattgagattaatcataaaatcaacactagattccaatattaactgtttatactgcattttgtttgttttactttatgtatctaaaatttgctaacagtatgactgtatccagtacatggatggatactgtatctagtacatggatggatactgtatccagtatccatcatatctcctaacttgccttcaaacatctgttggctggttaaaaaaatttaatcttggagatgaaaatttaccaaaacaggatattaaatgttttcaggttattccaactatttcaaacagaattttaaaaatggttttgaaaaatgcaataatcactgaaacaactgtaacacagcactatagtagttaaagtaataatactcatttggacaatctagtctgtctacaaaaaataaaatctcataaattaacgcatcaggtcaggttgcccgagagcattgttttttcaaacttgtcacctgcaactcattagtgggtagtctaatccatttagtggtttgcaatcagcaatgggaaaatcagaatgcattccacatagtaatggaacctactgttttgtgaaacttttgtttcaattagatgtacagatggataagcatgtactgggatgctatgtaaaatactagggattgcagtcaaagagtttgacaaaactagctgaaattatcttctgggtatcttcaactttagggtcctattctgtgaatttagtctttagctttaaataatgtctgttgttgttcaacaccgatctctaatatttacaaaatcatttttaggccacacagtttacttttagacaatgttttgttatggaaagaccaagagtcagtcagaattcaccttactagtcccaactctcacttaccataacttttaacctttaaactttagcacgcgattcaattaagcctcagtttcctcaacatactgtaagttgtgaaggcttattaagaatatatgagaacgagtgttaccttttaaaatagttttgctctctgaacaacagatttgcaattttgtgtccccaaaggaacttgatatagactagttccaagatctagagtcaaacaaatgtagatgtgaaaataaccttggggaaaaaaatagtttcagttggaaacctgtttcaagctacggagtatacagaattctgaggagactaaaattagaattaacatcttagctcaaatgtgggaccaggccaacattccatattgccatgtaatccattctgagtttccttatgccagttcccaactggctaggtgttaaagatgtaagtcagtgtttatatttacctttacatccaaaggtatacttgcttttatcaaatataatgtattccaaagtggggaaaaaaaaggttatctggtatttagactgtgcattctacagcttttccccactaacattcatagatgagagctgactccttatcaatgtaaaaccttttaaaggatgtggtggtgaatttctacaggattgagaggccctgtgttctatctagtcttagctctacctaagacatgtcaaatgataactgaagcaaatttatctttattctccataaaatattacatgtctgtccacttccactgatctctattctatgctccccaccttggtgccaaaagaatgtaatgcaatgcaatatgttctattgtaaatgcaaacatacaactttacctctcttatttcatctgtaaaataaccataataatatagtaataaattaatgtatgaactgcttagattaattccctgcataaagttagtgcttaaaagtactagctgttgttgctgttattttattggttctaaaatattttctgaaaacctaccatagcattatagaacaaaaatattccatgaatacagcaacaataatatatagcacttttgtagcatttcacacatagcaactaatttaatcttcacaacacccttatgaggaaggaaacattaactccactttacagataaggaccccaagatactgaaaggtgaaataacttcaagtcacagtaagtcacagtaagttgtggaacagagatactaatccaggaaacaagctcttaactactatgctttactcactctcttcaatgacgaccaaaaattttttttttaggattatgagtgatttttattttccttattcttttccatatttttccattttttacaacaaatacatttttcagagtcagaatgtgttcaaatataaatatgtaaaaagaataatttgaaaagtagttggtaactgaattctgtaggcaaaaattttgttattacctattttagattaccattctggtacacataagtgatttcataaaatactgtaccacttaagaataaaggctgggcgccgtggctcacacctgtaatcccaccactttgggaggccaatgcaggcagattgcctgagcccagcagtttgagatcagcctgggcaacatgatgaaaccttgtttctacaaaaaactaataaataaataaataaataaataaataaataaataaaaaatagtggggggtggtggcatgcgcctgtcatcccagctacttgggaggctgaggtgggaggtcaaggctgcagtcagtagagatcgtgccactgtactccaggcctgggtgacagagttaagaccctgtctcaaaaattaaaataaataaaatagtaaaaacagaatacataaatagcctttaaaactattttattttaaattattaacacataaaatttagcaataaccattttgataaaggccattattgcataaacagctgtactgataattctttttcttaaaaataacctccatcaattgttcggtcaatttaaaaaagatttaacaaataaactgtaaaggtgtattctttacataatagctatattatttaaaattgtatgttgttgtttaaacccaaacctcaccataaaactgtattttttaagtcagaagttgttttaaatgcattaggatatttgaaatttggaggactatgtctaaacattctgaaaaggagaacgtgcatgcatgcctgaatttatttacaatacacacgtggatttttagggttttttttgtttgttttttttttttttttgagacggagtctcgctctgtcgcccaggctggagtgcagtggcgcaatcttggcgcactgcaagccccgcctcccaggttcatgccattctcctgcctcagcctcccgagtagctgggactacaggcgcctgccaccgcgcctggctatttttttttgtattttttagtagagatggggtttcactgtgttagccaggatggtttcggtctcctgaccttgtgatctgcccgccttggcctcccaaagtgctgggattacaggtgtgagccaccgcgccaggccaatttttaggtatatttaaaagtacagtgtatgttgtatttatttaacatggagactagcaacagacagagattactggggaaaaataaacaaaaatatcctggatataatcatatctacctcttcactgcgtaacttcctcttctttaagactcttgatttcatcaattgctggataaaatgatttttaatttctgaactttttaattggccatgatgatgaaatcctagggagttcattttttaaaaaaaaaatctgacctgatatcaaagcatttgcagaatacctagcaggatgacatcttaatatcaaaatatgatattactagacttacaggaatcaaaaggaaaaccttatcacttaaaatcttatagttttctgagctattacatcaaatcaattcataattttttaaaaaaattccttaataccatgaatatttaagtagaagcaataatcagataaaagagacctctaatacttaagaatgcctgggatttctaagaaaggctagcttcaaggccgggcgtggtggctcatgcctgtaatcccggcactctgggaggccgaggcgggcggatcacgaggtcaggagattgagaccatcctggctaacacggtgaaccccatctctactaaaaatacaaaaaaattagctgggcatggtggcaggcgcctgtagtcccagctactcgggaggctgaggcaggagaatggcatgaacctgggaggcggggcttgcagtgagccaagattgcgccactgcactccagcctgggtgacagagcaagactccgtctaaaaaaaaaaaaaaaaaaagaggaaaaagaaagaaaggctagcttcaactacttcagtcaacttgaggcttaaactattgcttgagatttccagattatccaaattaattttttcatgttcacgataaacacatgaagaaaagtctgttatatctcaaatgtagtttaaatgtttgggtaacaccaaatcacataatcacgttcgtccatgagacctggaatcctgacttctatttccaattctgccattaatttatgtaggctggaatctcttttagatttcattttcctcacatgtaatactaagtttgatgtttcattgtcttaaattattatataatgctgaggatctatgtatatataggcttcattctctcattcagtttctgagaaattactttgagggcataaaccaagcatatttcttggtttcatttttgatttcaattagaataaatcacaagaaagaacaatggaaattacatgttaaccacaatatagtgtatgtgtaagacaaaattaaacatacctagtgcagcacagaataatctcatttttaaagctctgtgagtcaatgaataaataaaagaattacgttcatgtttcactagtaagagtgttcaccaatgctggaagctgggagctgaaaatgctggaagctgggttagactaggctattagaaaccagataaaaagggccagtgacttttagaggggattttgcagaacctcctggtagtggggctttttatctgtgccaatcacctttatctgtgctaattcctatttttgaacttccctattcaattccacatctcagccattccttttggtttttagatatttatgtgaaatgctagaactccctgactaattggaaccaagtttcacatcatcatcatcctctattccaagcttgctgtccccatgatcctcttaaaaatctgagtttccaaaacacataaacatacttgtatatcaaaatggcctttctctttctctctatatatgcacacatacacacataaacacacatgcacacacacccccacctgagctgaaccaaaggccatcttcccaaatattggagtctggctttatcaaaatatttgtggagtattaccagaagttcagattcataggctctacaatacagcttctaatctaaacctctagaggttagggccctggattttatttatttatttatttattttttttaaacaattttcccattcagatgtgaaggcagtttgagggacctcatgatggcaatactatattcttccataaacttataacctctatcttctcctttaagaagtaatttaaaaaatcttaatacatactatcattggaagtgcttcatctaagaaaaatgagaaattatctacttgtaaaagaacacacaaatgggtatatttacatatttgtaaatatgtaaatatttacatatttgtaaatatgtaaatatttacatatttgtaaatatgtaaatatttgcatatttgtaaatatgtaaatatttacatatttaaattaaattaatttacatattaaattaaattacatatttatattaaaaatgtaaatttgtaaatatggttttacatatttgtaaaaacctcatcacattaggaatgtcattcaaatgaaaggtgaagtctaagctcatgtttatcactgtactgttttctaaggaacaataacgaaaaaatactgaaaataagtcctaggggaactatggcagtaagttaaacgggtagggtgggggtgttcttaagcagttctaaggtatttgtgaagagacaacttatattctattgattctaaaattcacttttttcacattatctctgaaatcagattacaccatacaaatgatagcatcttacaatgaattgctggtatttttctgtcttagcagtaataaaatgatagtgtttcctacaatcagagattagtgaaaatactatcaacatgaattcttctcttgtcatcaaagacaatttctctaaaaacctcaggaaaaaagctgctagtctggtttgaatttcacaatatataaaagcaatgaatatatttttcttttttaaaaaaatccacaattattaattcaagttaccactcctcaacagaaaacatacaagagtctcatatatgaagtcactattttctgggcttgatttctaaactaaggagtggataactctaaggtttcttttagctcttaaagcctaggatcccataattttatttatcaatattaagcttaccacaaagtttctcatttcttcttttccacccaaccctgctatacaattccaaaattagcaagtcataaaaaagtggccactagtttgttcactgtgatatataagaatgaggcttaaaaagcagagatccttgggaaataagatcttgaaaaattcatcacttttgagctttcatatgagagaataatcttaaaccactttctattatagaacttctactatgtgttactaaaatatgtggctttatcataatcatcacctgctgtgaatacttacttcaaaaaattacacaggttatcaattttacttataagacctatttcgatgctggtttttctagtcttttcacattctgttatttttttaaaaaaaagaaaaggaagaaaaagcaagggagaaagaaagttaagagtaaaatctgcttagtgtgagcattcagagcccctaaggaagcttctctgtaagcatcatctctttctattttcacagtttattaaactgcctaacacacatgatttctgaagtgaactgcttttgtgggctggcaatattcaagtacatatactatctagtgaatcctgatttatgataggccacactatattatctaattttgatataattaagcagaacttgctaaaaacaagttaccataattaaagagctcacagttaattttacactaacacctaaggctttaaaagcagttgtttccttaaaattctagaatagaatttaaaatatagaataaagtatataccaagtacttaaacttttgtttttagtcttgctttactagagaaaaaaatgggggactgaggaaaataagactgagtagacttctgagcgaaagacagataaggaaggtagacaattttttgaaccctggaatgattcttacagtgtaatttcattgccttttaaaggctagacatagcttttgatgaagacagctgaagggatctcacctcaagaagccaaacataaagtatgtagctttggcatttgcagttctgctccaacaatggatagtcatagacagacctcaacatacctttcataaaacatcactcacattcttataaaataccctatcattctgctaaactatgtaaagtaaggtgctggctgccttatgatcagtcattaagtgtattaattattcatgtgtctcaaaactatgtaagtgaaataaaaagggtaccagaaagcaagcaataataatgacttcaggcagttaaagcccccttttgtctctgctagaaaaccacctgagttgcttaaataatgcagaatctttctccaacactataaacatatctgacattaaaaaaaaaaaacaaaccagtaacaaaaaaaaaaaaaacacacaaaatctctgcaatttttaatttctgagatgtcaaataactttttccaccgggctacagctttatgaattctcgaatttagacaattctaaaactaaaatttagacattctaaaactaaaatacattttaaagtaaaaatcacatttcctagttgtctgtgtcagacaactttactagtatactatagtattattaactaccttaatttttgttgacattaaattttacttgaagatgataaaaaagtagcagcaatgacagggatagctaatactagaaatacaataaagctctgcgataatgcacctgagacaaatgtaaattttggtgaaatgtgactgacgactgctttctgtcttctggccactcttatattcttaaacagatacactaaaattatcttgtggaggaaagaaaaggaacaaatggcaaccccatctggaaaaccaggaagttaggatgagtacctgagtttccagtatttccctgctcaatctccctggacttgatgttacaggcaccactaatccccagatttttggaatagctgctgttttccagaagttccaagacccagagttgtctctatgaatttttaagtgggaagaaactaccacagccaggcagtgccgtccacacagggatattctaagtggcccagcaggactcaactcttactggcaacaggcactgatctgccatggtcacttcatcaagtccacaataatgcaactctgaattttacacgatggaattttttggacactacctataattttatggtatggttttactgtaccattactcccagttcaagactgcacatccacacttattattgggtatctccacatttctcttgttctggtctttgtccaacactctattctcttctgaatgaaagaaactttggatttagttttcaagatttagaaaacccattctttttcaaagatagcatgaccattatataatacaaccgatactttgtagaacacatctataaacttgcacaggaacaacaaaagtataatacttatataagatcagaaatgtccatgtgttcctatgctatatggtatcatttttttcagtcacttttaaaatgaattcactgaactgtatcatgatatccccattattaggtttttaatctagcagcccaacttacccggacaagtgcatcatctatgatatggtcacgtctaactttgagtctcaaatatggattcaactgctgtccttgaactaagctgtagagaacagtgattcttcgttcactgtacatgcgaattctattgtcataatataatcccaaattctttgtgacagcattcaatataaagggacatgtcataaaagagaatttgttctctgtttctactttgaaaaaagtataatctttatccatttctagaacctcattcagtggttcattaataaactcttcaaaagggataagtggttttcgacaatccagggttttaacaccaagttcagtttccagggggtccactcgaggacctttcttgtttcttctttcttctcccaaaagttcctgaagtgtcagctcgctggactcagggatgggctcttcatcatcttcttcattgtgatttgtgtccacttcccctcccactacatttgcatagtaaaccattttcaagcacttcgaagcagcaacaatggcatcatcatcattcactagatttcgactgttaaattcattgcttatgactttataagtaataagttgctgaaatgtctccatcattctccgaatctggtctgcattgtatttagaccacagtctgatcagttttccttgggctgcaaggggtagcttgctcatcgctttgcaaaataatggcaaagccatttccagatattcaggactgtggagatttctattctccattacgataatgaacaaattcagataattaggatctcgagagtatacattgtgatacgtcaagtcacattccacgttaggtgacaaatatacaagtgcattgagaaaggcagtttcaattttttcattagagagcaatctggtgtagacccttctaatggcatcaatatccacagacacatcatcagggcctaatttttgcaaattgttgtctccctgtgagctatcacctatccttgaggaagatgcttctgagtcttcttccatagcagcagcagaacatgcagctttttccttttcatcttcatctttgtcttcatcttttgcttgaagagatttcagttcttccttggtgtgttgtttaactttccggaagctctgtaccaatgcctcagcactagaaaaaactcttccaataacacggattaaaggggaataatcctctctttctctacataattcaagaatttcatataccttctcttctgttaagtaagtcacatctagaaaatcagaggaaaaaagagaacatttattttcataatatgtatgtttactctgttgcaaaaagttctaaaagtaaaacagccaaacattctaggctcaatatcatttatgatatacaactcttaaagtatctaatacttagattcagcaaacaaaatttaatgcttacctatttttttcaatgaactacctacctataccaatgacctcacccatgcttttacattctttcaacaatgtataactcttaataagatcatgagtttaaactttctttataatcaagatatctattaatgtatagctttaattataaatatgaaccaatatgtcatgtactgattaatcataatacagctcttaaaacctcactgtagaacacacagaaatactactaatctgtgagttttcttgtttcagtactctgttctccaaagactaagaaggcaaggtcttaaaaaaaggctccttcagcatctatgtatgtattaaaatcaaactggttcattttgggtcttcctagtttgttccagggtagtcattctgtgagtgattgagaagaatataccatttctcatcggctcttaagtagaaactgctttccacagccaggaatcaggttagactaaatctcatagagtgacagaaaatagtttttgagcaatgaaaacaaacagtgcaaagaagtaaacttatgagctggcaagcagtgcagagactatgtagtcatcaaaatctatttcctcttttcctgggcacagagttggaccacatttcccaactttttgagataagtgttattttcaggccaaggctttctcccttctggctaataggatgaaagatatttcatttcacaggtaaaaacaaatgatatattttgtgtactgaccaacataatactgagaatagtcttaattctcccttttatcaataaagtgacatacttgtcatcatcagattaactacttgagaggttaattttagaggcacacagacaatcctacctccattgcgccaaatatacccttatacatgtagtgtacaacatgtagaatttttaatgactcccacctctgctataatatatgtttcacaatgaaagacaatataaaatgtaagtgatcattgaatggtctccaaaaattgaagcacaaaaataccaaattttatcatactaaggatctgatctgtggcccagctacaagagtaccaacacttacagtttcttttatgggccttaactctttaagaactaattctcaggtttgttctattaagaatatataagcatcttttgctaaacatcagtaacctcttccccaaaagcataaaaccactggaaacctatttctcattattttcattgaaaatttttaaaataccttcttacaagacaatgcaaaactcctaatttcctaaaatgtaacataacagaaaatactactatcctattaggacatgaaacactttgcttcctgagcaagtcataaggttaacaaagacttgctttgcatgcagtaatatggcctgtcctagggatcaccattctagactcacatgtcctttgttgatatgtcatgctttcggaacatcttcaagtgattctgacagtctactaatcctatatagaatgtacctatactttttccaaggagtgttttttgttgttgttttttgacatggagtctcactctgttgccaggttggaatgcagtggcaccatttcggctcactgcaacttctgcctcccgggttcaaacgattctcctacctcagcctcccaagtagctgggactacagatgcacgccaccacaactggctaatttttttgtatttttagtagagagggggtttcaccacgttggccaggttggtctcgatctcttgacgtcgtgattcgcccgcctcagcctcccaaagtgctgggattacaggcgtgagccactgtgcctggcctgtagtgtttaatatgttaaactgaatttttcaggtatatagataaaaattagtcaaaaaacactgtaattagatatgaacattcaaaaagtttggtttattgatacaggtgttctactgagaaagacatttttataagatttcttgtgataaatgtgtccctgaaaatactcaatcttttaaattttgcacttaaaaacctcctacgcaaaaacagtttggtgcagactacttaatacttatgcaactttgtaattagtgttaacaaacataattaataatcaaaataagagtactagtgtacagaaagcatctctaatttccaatatacaatagtaactatagaacaatgcaaaaacaaaaacaaaaaaaccagtaacgaacagggaacagtaacagtagcatattagaaaacagggataaggaaaggtcacaactgctataatgcagacttgagcaaaaagaggagggggcataaagactggataaagccacacaataagcacctctaagatggagcacgtggccaaaagagcagatgagcacattcctcatgtaccacatcccccgcagctggctgcattccactgtgccagcactctacattcagttactggtactctctggtgcacacttactggagaactgtgtacaataaagtcaatgcagcttccacattatactgacacactatatatacagacaacatttacctattttcccatagtgtgtgaactaattcatgaaacagaattatacactctgaagcaacaaagttgtgtaaagtgacgaaaataattttattgtggaaacagagtagaggttataacacaatgccacttcactaattctttcaaacttgattcaaatgatgttagtgaaagttttagaggcaaatgcctctaaaattctctgacttgtatgtcataaaaaaaaagctttctctcttaaaatacaattgcctctgggtgtgtgtaggggtgagagtggaggggcgctaagccctggtagtcattcaaaaatttgattactttgttactaattaccttcactgaagaaaataacttggagttttagtattagcgacaaggtaatcgaattctgaattttggacgtaggaccatttagaaaacaaaagacctgagtgaagactgtcattggtaggtcatgatccttggcagcatgactgtaccaaatgtccggaaggagagtgagaagcatatatctgaaggaaacgtagaattctcacataactatcacaaaattttgtcttgccttcaaaaatggaaaaaacccactgtttcctctttctgcttctttcatcacatcatcctgaggttccagaactcatgccagatacttagtccagttattctataacttaaatagatgttgtggcctagttttggagattcactaccacttaatacatttttcctaagaattttaaaaagttcaaatcaatctattaacaaatgaacttttggcatatgatctgcttctaattagcaatgattagacctgtaaaatgtagttattattcctgtccgttaccacaataaaaaattggttctacgatatcaaaatgtctttatgtcacagaagaaaaaacaaataaaaactaatacatttaaatctcccacatggttttcaggcaacaattctcaattgaaaataaaacatcttacctttaaaatcaattctagcgcctttcttgttcatttttatctcagagcaggagttgttgggggcacctttcgagttctcaaggtaagctgagcttgctcctttcttggagggatgaggatcacagagttttgcattaatcttataaagctcgagggctttaatagctgctgcattattatccatacgaagaaaagttggacaggaagcacaaaactcattcgtgcaggcttcatttccacagccctcagttaactggtggtagtagcgttctattagatgctttgcagctgctcgcttcctgtaccaaacattcaaacaataagcacagtgattagtacagctctcaagtacaaagctcaacatatcatcaaggcaaaagttagtcaagcactgaagtgattaacctgtgtatgaagatgagaagtagaaaatggagatgcactatttaccacaactcctgactagtgaaatagttaataaatattttctaggatattatgataaagaatgtcaatgcttactgactgtattaacagagtatacattcctttggtttaaaaggggggaggggggcttgtctgatggtatatgtgcttaagttgtttagtacaacagctgaaaaatcacaaggtttacagctaagagttgtaggattctatcattttaaaaattagcattaggaaaatgagtctatttaaagcatcaatccggttttcttttacataatcagtatttcatttttaacagcttgtaaacatttgacttatagttaacacagaatatctatctggaataaaaactatttttcccaattatcaacaacatgggagacttaaaaataaatttgtaagtggaatatccaaagatagtgttacactgaaagaaagcggctgcagcctgagtgaggcagatcatgactgtaatcaatcccataactgtgggaggctgaggcaggccgactacttgagcccaggaggtcaacaccagcctgggcaacatagtgaggctactctctacaaacttttttaaaaaaaattagccaagtgtggtggcatgcacctgtagtcccagctacttgggaggctgaggatcacttgagcctgagagtcaaggctgccataagctgaaattgcaccactgcactccagcctgggcaacagagctagactttgtctcaaaaacaaacaaacaaacaaaaaccaaaaagaaaaagaaaaagaggctccaaagtgtagaatcttaaatctaaaacttgtcactaaacctcctcattagttccacgtcacaagatggaatattttaagttccatcacgtgaaatcttatattccttttactctgtcaacttaaagtacacagattaatgtcctattatggctgtttcaggagagctaccaaaactgagggaggaattatgtgaccatgtaagaagttagatgacattatattcaacactaaagagtctatgcttctactaactgataaaattaccataatttcagtagaataaactactggatccaaagaaacataagtcatagccattccttttggtcccaaattcacaagcatggaaataacaactacaaagaatcaaaattataagaaaaatagttcagctgattttcaaaacattcacagaattatctaacatgtaggactagatgaccaatgccagagtttacatcttgctaatcatgagaaactcaacaattaacaaggcagcaagtaagtgaagaaacacacgagatccaattttgtctcaacagaagaactttcactctctgtccaggtaggtgacaaaaagtgataattcacacacattcaattcattctggtgcttatttttcaaatgttccatgcaaatttaccactcactgcatgcaaacagagaaaaaagaaaacccacaaagcacatgtaaaaattgcataaacatgacttaaagacattttgctatctatgaagctataaaccccacctgaaaattaaaaactgttatcacagatttagcactatgcaaaatatgaaagtgaaaacatgtaaaaataaaatggaaatgcagaatctagaaaatttaaaatatatattgctacccttcagtaaagaaagggagataatgtcatgttctcccaaactacagtgacttccctggtgaaaatgtaagtaggtatttcctttctggaggaaaacagtgaacatgtatcgaaagtcttaaaaacacgaataccgtgtgaatgagatcctacttgtggaaaataatttgacaattttacaaaaatgcattgtttctatatctgaaaaaaacatgtctaataaaagattacttaaatgaactgataataggtcacacaataaaataaaaactatcaagatttgaattcgacaaagaactgcctagtcttcctgatatatcactaactgacaaaagtcagttaaaaagtagcaggtgtaggatgaacccattgttatttcaaagcattaatagcattttctctggatgatgtgattaagtgagttttaaaacttcttccatcttttgatttcttatttattctttccatagtaaggatgctacttgcatattaaaaattaataactataaggggaaaacaatagcagttataaaacttcatatacatgatttgaatggccccgagatttactaaattgtctctgatttttaaaaaaattacaaaagtcaaaataccaaaatagatatttttaatgtgagcttttatactaaaataacctccccaaaacttgtcagatacatagtacttctttatatactacataggaggagagtgatcagcacaaacagaacgagactgaaaaatcagaagatctgcattaagtgtcatccttctgtccctaagcagctgtaggatcctagggaaacaattgtctgggcctcagttttcccagctttatgagtcccttcagttctaattttaaagttattttatgtaatagggaggtgagcaagaaactagtatttgctggatgcctgataacttattacacacactgcggggcactttgacatgggttatctcatttgaataccatgacattgaggattatcttcagtccacagccaaagagagaaatagaactggagtcaaatcacgaaaccaagatctcaaagaaagtacagaaccaagacaagaataggagtccaggagtctttcagcttcagagtctaagtcattttgactatattgttttgcagaaggtgattcatttcaaaataattattttttaacatgagtaatactgaagaattctatggaaaaaaatctcataactaatgtgcaactgggaaaaaaatctgaagaatcataacgtgaacctcacatttatgcatctatctggtaccacaaaggcagaccaagtttcttgaggaaatggaaccactatattctgcaaagttaatttctctctaatttgttgaggacctatgtgctatgcattttatagacattcccactttagaggggaataaaccttaacagttaagagctcgcattctgaggccagatgcccaagttcacataatggctctacctcttaattaactatgtgaccctgaatgaattacttgatctttctggacgtaagtttcctcgtaatttaaatggtagtatctacgagcattatcatggtgagagtattattcttcttcacattaccaattgtgagaaaattaaatgtgttaatatatataaagtgcttagaacattgcctggcacatactaagcactatgaaagtgttagctactactattattgttgtaattgttactatcaccctcacaagtgtatgagttagcactataaaccttcattctgctgatgctcagagaaattacataagtcatacatctaataagagatttgaactcagctactaaacttgagcttttaataactattaagaggaggatctgaaagtagccctctatatttgatctgcctttctgtgccaagtttaacaaatagcagctacactgatgagacaggactaaaggaagccatgccagaacctccaagttaatggtggaatcaactatattaagcattcttcttttttcctcactccaatgacaccttaatttatctgacctcatctgcatcactatctaatttaggatatgtaaaaggcatacaaaatttagagcacataaaagggcctctacgttggaaaagtatacactaataacgactttttggtatagttcctgcgcaagggaaatccttgtaccatatgggtcaccaaatcatagctcgtaagtcaaatcgagtccaccacctgtttatgtctctcaagcttagaatattttacatttttaaatggctggaaaaagtttgaaaaataataatagtttgtaacgtgaaaattataagaaattcaagttccagtatccatcaagtgtactggaacatacccaagttcattgatttataaatatactatatatgataatgctttggctctgtgtccccacccaaatctcatcttgaattgtactcccataattctcatgtgttgtaggagtgaccccctgggagataatctgaatcatgggggcagtttcccacatgctgttcttgtggtagtaagtctcacgagatctgatggttttatcaggggtttccgcttttgcatccttctcattttctcttgtcactgccatgcaagaagtgtctttcacctttcgccatgattctgaagccttcccagccatgtggaagtgtaagtccaattaaacttcttttttttttcccagtctcaggtacgtctttatcagcagcgtgaaaaaggactaatacaatatactatatagtttatggctgtttttcatactacaatggcagagttgagtactttaggcctgcaaaacctaaaacaaataccacctgccctttacagaaaatgtttgccaacccttagtttaggatctattatttatctctgccctccagtgaccctgccatctaatcatttggcctcttaactctctctttaccctgagcaaatccgtaaaataaaaggtatacctttccccaagtactattaaagaaaagaagaggagaggggaaaagggaaaaaggggaaaagaaagtgaggaaagggagaggatgcaaaagaaaaagaaggaaagaaaggaatttccctgatgagatcccttagtaataccttatcagctgttcataatcaaaattcctagaagaggaacaacagcttacttgctataatttcttcacattccattgacttttcttattactcaaaaaacaaagtatgttataatgtgttgatttttaaaataaaacaaacttttcttatttagtcagcaatgaaggtcaagtgagaccttctagtaaaagtcctctaaagtcagacacatgaaaatacttatccatttaaaacagacaatactttccaattatttatttctatgattgaattaatgggacagtgctacaaacagaagtcctatggaataagtcatacttggaagatcagagtttactctagacaacttgacagcaatcagtttaaaaatggtttcacctagagggatgtgtactaatgttagcaattaactttgaaaggcataaaaattaagatggattgatggatacaaggatggttatacgataaagcaatgtaagtattaatggcagaatctaggtggcaggcatatgtgtgtcagctgtaaaatttgtgttcaatgtttttttagttcccacatatcagtgagaacatgtgatatctgtctttccgtgtctggcttagttcactaaaaaaatgaatttacaagacaactggaatataagcaatgaatacaagcactaagaagatgaagccatagaaacagctgccagaaagtgaagatgtgacagtgaacgccaaacaagtaagattagaattacaattagaatcagaaatgacaaaaaagaaacatgaactgtgagatgcaatataaaaactaatggtgaacaaagcaaagaataaaaaataaaaacggaaagattaaaaggaaaatgtgactgtaagtagagtgacctttatattatacagaaggtaaagcagaatgaacatgtgaggaatctaaaaaacagatataaaatagaaacaactgaaggcttatataattagtctataaagctaggaaccactgcttagtaatttctcgtaagtggagtctctttgttctgagacgttgcaaaactccattccatctcaaagttatttttaatgttaaaatttgtaagagtgagcaacggtatcctaaatagttctaggccttgtagaaatagactgtaagagacatctgtgacacaactatattcagtatgatgtagggtctgttacaatgggatgaagtgaatttagattatttcaagactaaacctacaattgtgaactcattagtaccatgaaccgaacaaaaacctattaaatatagaacaagacgattttcatgaaaaaataaatatgaacaaatcagtattttcagttgtttgaaatataggttaaccttcaattactgttttatggccgggtgcagtggctcacgccacgcctctaatcccagcactttgggaggccgaggcaggcggatcatgaggtcaggagatcgagaccatcctggctaacatggtgaaactacgtccctactaaaaatacaaaaaaaaattagctgggcgccgtggtgggcgcctatagtcccagctacttgggaggctgatgcagaagaatggcatgaacccgggaggcggagcttgcagtgagccgagacagagccactgcactgtggcctgggcaaaagagcgagactctgtctcaaaaaaaaaaaagaaaagaaaagaactgtttttttcatttttatagtctcaatatccagaatgcgtgatatatgataaaaaaaaaagtaaaattgtagaactaaatatttacataattcatctgtaaaatgaaaatctgttttacagtgtcatatttcacagttagaaaggaagaaaaaccttaaatcaacaaattaactttacatcttatggaattaggaaatgaagaacaaatgagactcaaacttaccaaaaaataaaaaaaataaaaataaattacagctaaaataaaatagagaaaaatagaaaatttttgcaatagaaaaaaaatcaacaaaattaggagtagctgttttattgaaaagatcaacaaaactggcaaattcttagattaagaaatgaagagaatagacacaaacagcaacaactggaaattagaaaggcgatacaacaactgctgccacagaaataaataggaccttaaaagactaatatgaacaactatgacccaaaaaaatttgataacctttgagaacggatagacacatcaaacccaccaagactgagccacaaatacatacaacttctgaatggacctataactattagagattgaatcagtaactgtccaacaacgccagggcttcactgaaaactctaccaaacatttaaaaactaacaacccttctcaaactctttgaaaaaactagaggacagaacactttcaaaatcattttatgaggtaagcattacttagatatcgaaatcagacaaatttacaagaaaaaagaatccctaataaatactgatgcaaaaaaaatcaacaaaataccaagaaacagaattcaacaatgcattaaaaagattatatttcataaattctcaactggaatttattcataaaatccaaggatggttcaacatacaaaaaaatcactttaatacactgcattcttaggacaaaaaccaataatctcaactgactcagaagaagcatttgacaaaaatcaacacccttttaggatttaaaaaaaggccagacagggtggctcatgcctgtaatcccagcactttagaagggcaaggtgggtggatcacctgaggtcaggagtgtgagaccagcctggccaacacagtgaaaccctgtctctactaaaaatacaaaaactaatcgggcatggtggtgggcgcctgtaattccagctactcgggaggctgaggcaggacaatcacttgagaacccgggaggcggagctggcagtgaggtgagatagcatcattgcactccagcctgggtgacaagagcaagattctgtctcaaaaaaacaaaaacaaaaacgctcaattcgctagaaagatatggaaattacttcaacataatgaaggccatatatagaaagaccacagctaatgttattcaatgatgaaaaactgaaagttttccctctaagatcacaaatggaacaagaatgcacacattcaccacttctattcaacatactgttagacatcctgccagagttagcaactgggcaagaaaaagaaatgaaaggtattaaatgagaaaagtaagaagtaaaattacttctgttagcaaatgacatgatcttttatgttgaaaactctagcctaccaaaaagaaaaaaaaccgttagaataaaggaattcagtaaagttacaggatataaaaaccaatattaagaaaagagttgcatttctaaatactaaaaatgaagaatccaaaaaggaaattaattttttaaacccatttaaaatgaaatcaaagagtaaaaaatacttagggaatattttcaccaagcaaatgaaagacatgtacattgaaaattaaacaacataggccggacgtggtggctcacgcctgtaaccccagcagtttgggaggccaaggtgggctgatcacgaggtcaagagattgagaccatcctggccaacatggtgaaaccctgtctctactaaaaatacaaaataaattagctgggcttggtggcgcgcgcctgtaatcccagccactcgggaggctgaggcaggagttgtcacttgaatttgggaggcagaggtgcagtgagccaagatcacgccactctactccagcctggtgacagagtgagactctgtctcaaaaaaaaaaaaaaaagaaaaagaaaattatacaacaatgctgaaagaaattaaagacaatacaaataaatggaaagacatccaagtttatgaattggaagatttagtactgttaagatggcaatactacccaaagcaatctgcaaattcaaagcaatccctatcaaaatcccaatggcattttctacagaaacagaaaaaaaaaatcttaaaattaatacagaatcttgaaggaccctgaatagccgtaacaatctggacaaaaaacaaagctagaggcctcacattccctgatttctaaagatattgcaaagctatagtaatcaaaacactatggtgctggcataaagacagatatacagaccaagtgagcagaagagagaacacagaaatagggaaaagaggttcttcaacaaactgtattgggaaatctggaatctaacatgcaaaagaatgaagttggagccttatctcacaccatatacaaagatgaactcaagctggattacagacctaaacttaaaacatcgaattataaaactactacaagaaaacatggagaaaaagcttcatgacattggacttggcaatgatttcttgaatagatcaccaaaagcacaagcaaccaaagcaaaaatagacaaactggggatacataaactcaaaaatttctacaaagcaaacagtaaatggagtaaaatggcaacctacaaaacaggagaaaatatttctataccatgtatctgttatttggttaatatccagaatatataaataactcctacaattcaacaacaaaaaatctagttaaaaagtggacaaaggacttgaatagtcatttttccaaagaatatatacaaatgggcaataagcccatgaaaagattctcaccatcactgatcagtagggagaaatgtcaattaaaactgcaatgatacatcatctgaaaccattaggatggccaccattaaaaaaacagaaaataagtattggtgaagatatggagaaactggaacccttatgcaccactggtgaaaatgtaaaatggtgccaggcactgtggaaaacaacatgaaggtccctcaaaaaatttgaaatagaattacctccagttccacatatgaagagcttggaagtcaccactccatcctaacaacaagtaaaaaatgacaaacttaaaaataaacaaatctgagataggataagtgaggtcacagggcaaatgactgcctgtgagagcagagaacaggtgaacacatagcatcaccatttatctgagatgaaaaacacaagcagaaacctccacggggtaggaaatcctgaagtgtaatagacaaattgatgaaggctcagtgtggacaactctgaaagctaaaaactccagagttacccaattatagggggagccctacaattttctaagttttacatccaggcaattgaccagcttctcacagtaaatataggagaaaaatcctcaaccctcagcaggggaggcaaagagaaatgattttcaagtacactagactattccagtcttaacaaggtttgtcctcaggagaaactagttaaccagagcctaacctgctggggttgtagcaaagccaaaatgatgtgggggaagagaaataacccaacttcaggccattatagctatcttgttctaactaagggaatgagggaggggtgggattgagaaacacttgtgaagttcacagtccagaggcataagctcactaaaaagactgacctaatcataagactacagaactcttctcctctccctacaccttacaaccacattactaaatgctcatttacaacagttccttttacctagtacatcatgtccaagctatcaagaaaaaaattacagggcataataaaaggtaaaaaacaagcaccaggaccagatacagcagggatttggaattatcaaacttggaatctaaaacaactatgattaatatgctaagggccctaacgaactgagtaaacaacatgttaaaaaagtagagatgaaaatcctaagaaccaaaaggaagtgctagagataaaacacaaacaaaaacaaaaaacagaacactgtaagagaaatgaagaatgcctttgatgggcttattagtaggctgggcatggatgaagaatctctgagcttgaaaatatgccaaaaaactacatctgggcataaaacgttgtaattacagaaattcaaggataagaaaaaaatccgaagtaagccagagggaaaaaatcaccttacctgtagaggaaaaaaagaaaaaaaagaaaaaatacatgtgacttccaacaagaaaaagagtgaaatattcatagtgttgagagaaaaaaaaaccataaacctagcactctaccttgtgagattattattcaaaagttaaaaagaaacactttctcagacaaaaattaaggaaatttgttgtcagtacacctgccttgcaataagtgttgggaagttcagaaactgaaatctacatatatagagcatcaaaagaaggaaacactgaaagtaaaataaaaccttttatttttcttatacttaattgatctaacaaataagaatttgttcaaaataatgtcaacaattgtgcttatgcatacaaatgctcctaaacttacttattgggttgtgtcccaataccattataaattgaaaatatcatgaaaacacaacttatccaaatttgtgggatacagtgaaagcagcgcttagaaagaaacatacaacactgatgcatttattagaaaagaattatctaggccgggcgctgtggctcacgcctgtaatcccagcactttgggaggctgaggcgggtggatcacatggtcaggagatcaagaccatcctggctaacacagtgaaaccccgtctctactaaaaatacaaaaaaattagccacacgtggtggcaggcgcctgtagtcccagctacttgggaggctgaggcaagagaatggcgtgaacccgggaggcggagcttgcggtgagccgagatcgagccactgcactccagcctgggcgacaaagcgagactccatctcaaaaaaaaaagaaaagaaaagaatgatctaaaaatcaattatctgagctaccaacttatgaaactagaaaaagcaaattaaatccaaatagaagtaataaaaattagagcagaaatcaatgaaattgaaaacaagatatcaatagagaaaaatcaaagaaatcaactagttctctgaaaagatcaataaaatcaataagcctctagccaggctaagaaaaagagacaaaggacaaaataactaatatcagaatgaaaagagtggacatcattacagatctcatggacattaaaaggataatcaagggatattatgaacaactttacggccacgaatttggtaacctagatgaaatgaatcaattccttaaaagacacaatctattagaactctaagaagaaataatcttgattaaaaagcatatattaaagaaattaaatccataattaataatgttctaaaagagaaggcatcaggcccagatggattctctgatgaattctactaaacatttaaggaagaaaccacaccagttctctacaatctccttcagaagacagaagcaaaggagatgctcctatctcattgtatgaagtcagcattactctaatacccaaaccagacaaagacattatcagaaaagaaaactacagacccatatttgtcatgaacaaagatgcaaaaatctttgtattagcaaagtattagcaaactaaattttactacaatgtataaaaagaagtatacaccagcacaaagtaggatttatcccaggtatgcaagactggttcaatattggaaaatcaattaatgcaattcaccatatcaacagactaaagaagaaaaatcacatgaccataccatagatggagagaagtatgtgacaaaatttaacacccactcatgatagaaactagtaaactaggaatagagggaacaccttcaacttgataaagaacgtttacaaaaaacatacagctaacaccatccttaatgatgagaaactagaaactttcttactaagatcaggaacaagaaaagaatatccccacctcaccactccatactggaagtcctagctaagacaagaaaaggaaataaagggtatactaacggggaacaaaaaaatacaactgcctttgtttgcagatgaaatgactatatgtgtagaacatagacaggaattgaaaaaaagaaaaagaaaaacaacaaaaacctcctagaactaataagtgattatagcaaagctgcaggatacaaggttcatataaaaaagttaatagctttcctgtaaaccagcaatgcataagttgaatttgaaattaaaaacacaataccattttacattagcgtgtcccaaaatgaaatatttaagtacagatctaacaaaattagtacaagatatatgaggaaaaatgttttagaactctgatgaaagaaatcaaataactaaataatgaagagctattccatgacccgtgagagacaactcaatattgacagaaaaagtcagatggacactactgatttcaagatttactgtaaagctacagtagtcaagatggtgtggtactgacaaaagaactgacaaaacagaccaacgaaacagaatagagagcccagaaatggacccacatagtcaaaggagcaatggcagtatttgacaaagaggcaaaggcaatacaatgaagaaaatagtctttttcaataaacagtggtaataactgaacatccacatgcaaaaaaaaaaagagtctagacacaggtcttacacccttcacaaaaataaactcaaaataaaccagagaattaaatgtaaaactcaaaactataaaactcctagaggataacataagaaaaaatctagatcttgggtttggtgatgacttttagatacggcaccaaaggtaccaaccatgaagaaaagaactgataagccagacttcattaaaattgtctacttgtttcttaaaaattgttgtcttttgcaaaagacaatgtcaagagtatgaaaagacaagccacagatagggaggaaatatttacataagacacatctgataaagaactattaactaaaatgtgtaaggaggctgggtgtggtggctcacatcccagcactttgggaggccaaggtgggtggatcacctgaggtcaggaggtcgagaccagcctggctaacatagtgaaaccccgtgtctactaaaaatacaaaaattagccaggtgtggtggtgcacgggtataatcccagctactcgggaggctgacgcaggagaatcacttgaacccaggtggcagaggttgcagggagccaagactgtgccactgtactgcaacctgggtgacagagcgaggctctgtctcaacagacagacagacagacagacaagacagacagagacagtgtaaggaactcttaaaattccacaagaaaacaaacaacccaattaaaaaattggccaacaaccttaacagacacctcaccaaagatatacagatggcaattcagcatatgaaaagatgtcccacacatcatatggcatcagagaaacacaaattaaaattataagatacctctacacacctatcagaatggacaaaattcagaacactgataacaccaaatactggtgaagatgtagagcaaaagaaacactcactcattgctggtgaaaaatgtaaaaggatagcgtcatattagaagacagtttggatgtttcctacaaaactaaacacttttaccataagatccagcaattgcactccctagtatttacagaaagtcgctgaaaacctaagtccacacaaaaacctgcacaccgatatctacagcagttttattcataattagcaaaatgtggaagcaaccacaatgtccttcattaggtgaatattcattcacaaactgtgatatgtccagaaaatggaaaaagagaggtactaacaacctatgaaaagacatggaagaaactttaatgcatattagtaagtaaaaatagtcaagctgaaagggctatatactgtatgattacaagtatataatatgctggaaaaggcaaagttagagacacagtaaaaggatcggtgattgccaaggagtgggagggaaggaaagataaataggcagaacacagaggattttggggcagtgaaaacattctgtatgatataatggtagatacatgtcattgtactttgttcaaagccacagaacgtacagcactaagaatgatccctaatataaactacggactttgggtaattatgatgtatcaatataggttcatcagaaagacatgtaccactctggtgggagatgcacactggctatgagagaatccatacatgtgtgtggaaggaggtacaggggaaatctctgtaccttcctctcaattctgtgaacctagaactcctgtaaaaaaaaaaaaaatctaaaaaaaaatagaatacatatgatccagtaatcctacacctgggtatacttccaaatatattaaaaacaggttctcaaaaaaatatttgtatacccatgtttatttcaacattacaatattcaagaagtggaaggaacctaaacatccatcaacaaatggttaaagaaaatgtggtatacatatataacaaaatgttattcagcctaaaagaaaagaaagaaattctgtaatatgctacaacacaaatgaaccttgaggacattgctatgtgaaataggccagtcaacaaaagacaaatacttaatgattccactgacatgaagtagccaaaacagtcaaattttagaggcaaaaagtagaatggcatttgccaaggaataggaagaagggggaaaagaagagttgttcaatgaatgtagagtttctgttttacaagatgaaaaagttctagagatctgctgcacaacaatgtgcacagttaccacaattgtaccgtacacttcaaatcattaatatggtaaaatgtgttgtttttgacaatttttaaaactctaccccattgttttctttacctcttatataaactgataaaaacctgttttatcttaatcaattattgtatgactactgctccccagagaaaaaagtgcatgtgaaatactactacttatccatctcctggctctgagcagtacatgtcaggaacaagagggaattgtagctggaagacagtagaagagccataggacaagtctctaagagaaggaagaaaaggcgcaatgaaagaaaacaagtttaagatagtagaaaagcattcaaagacggcaacctgaggtaaggtgttttcactgaagcttttggggtaaaacagttttgagttggcatgcctgtagacatgggaagcagcagtgatgcagaggtgaacattactgtagataaaaacggatgggaatttgacttgctagggactgaggggttaatcatataaataaagatggcagcagatttgggaaagagtgaagaagaataagttcaggtagcagtcctcaaaaaccgagaagaaactgatagctcactgaaggcagacagaggaagacaaaaccagaaggcataagcttcaaaggagcagggatttttatgctgagagagtaaaaggaatagttcaaagcagcagtggagaacacgaataacgttccatgtgggaaaagaacatgtccagagcttactgtacctataacctagcttctgtaactggaaatgaagaatctgctctagtcaggtcatcacttttcactacttattttacttggccttcctaagaaatatagaccttttggaaattattgacttttgggtctaggacactatttcttggtttcctcccttctctctggctgtttttcagagacttcccttccaaatctagagacatttgtattctccagggatcagctattagatactttcccttttaaatttccctttggacagtttcatctttcaaggattgagcaataactaaatgacttccaaatgtctacttcagtataaattctgcttgtcaggctacataaaaagggctcttcaaggaattatgatgtctaaagaaagagaaagccacgatttcaatatcacagagatgactacagaggaatagcaataaaaagagaggcaacttaggagaggtgaatcacaaaagatgactaggagctgatgacactatgggtgggaagaatgtttcagacaggggaagaatgtttcagatagaggaaaatgagtaaaagcacaggggcctgaaaacatgatattataagacaattccaagcacttcaagagcctaaagttcaagaaaagtttcaaaaatatgaaaatggagaggcagggaaaagccagatcatggaagacctcaatagccatgataagtaattctttttttagccaaaagaggagtaatctaataaaagctaaagatcttctcctcataaaaatacatgcacacttcaggagtgcaaatgcactcttccggaagattcgtaacccactacattcataaaccattagataagaactaaaacacaaggagtcactgaagggttttaagcaggttaagtgactgacaaaatttgccttttcaataactgaaaccaaagtgggcaaaactggaggcaagcaatccagttaggtaatgactactgtaatagtccggacaaataatgtagcagtaggaagaaaaaaaaagatgaaattgacccaggaaatatttaaaataagtagtttgtaagaggtaaataagctggaagagccagaggtaatgggtagggtttctggtatgggcaacaagatatgctacaagctgagatgttagtaaaaacaagcgttcatcagcatttagtaagtgatttatttatattatatcactgaatactcaattatgttaagaggcagacagcagttaaaaaacaaagaactcggtgaatcaaaaagttctgctaatttggggaaatagcatcccttttatttttgttaatctcttttgggtttgatcctcatttatagctgacaagaagttctatgtactaaaggtaaactattctcattaatgttcccaaaaatctcttggaataattaagatataaagaaattcaaaattcacatgattataaaaatctttccttagataatctcataatatagccatgttttgctcattctactttgagaagattcagccagaaacagttcatccattcaactatccctactgtgaactagaagtatgtttccttacatttgaaacagaagatataggtttatatgatgcttcaggtggtagaaaagcagggcagactatgactcgtgtcacttccttccacacgtgatgcctttcatgggctcctgtgtctgtcagaagaaagcaaagggccttagcgtgctcctggctttctatatccaaatgcattttttcacaccttctcccatcagctaactctacattactgcaatacggaacttcttactactcagtggacttgttctgctgtcttctctgattccaggtgttattcttcctgcctagaacactatgattcttagctattcccaagcatcctcaaggtttcagcttatataccacttttaagataattaggtattcttcctctgtagtctcataccaaccagtacctattctattatatataataactgcctattaattaaatgggaagctgaggtatatgacctaataacttatttactgtcgtatcctcagaacctagcaaattacagagtctcaacagagatttttcaatttctcttctgatactgtctcgataacagtgtcaattaaacctttctctaattatttgaccttgaagggaaatagatgtcagactacctcctggtttcgagtatactggaagcatacaaaaggaccttctcaatctggagaccaagaatatgatatgagaacctataggagaaccacttatttgattaaagagatttcttttacttcagaaaatatttcagtatgttacttgacccataaatgcttatagatgtgtaagtacaccgaagaagtcatataggaaataaaagcatccaagctatatttctatggtctactctgattaaaaagctcagctctcctatcaaattcaagataatgcatgtggattatggagcacagtcacttgctacatggtaaatgctcaaaaagatgataggtggtattacccacattctacaggctgtgtacatacttatcagtttatatatatacataaactgatcctaaaaaattcttcctacatttctgcaagataattaaaaaggcagaaacaaacattttgcataaatttactagcttcattctttcatgtaggaagtagttactgactacctactgtatgccaggcactgtcattaggcttccattctagtggtaaagaagcaaaacaacaaagaaatcaatatgcaagaagtcaaatgacattaaatcccatgaagaaaaatgcagcaagttaaggggaatgcagaagaacatgatcattctttgatgcagccggtcaggaaaagcatcatttgagcagagagctctctgaatcaagtgaggaaggaagccacatggattatcacagagaagggtcacagggtcacagacaatagttacaagccttaagatgacaaagatacagccattttagacagagatgagcaagtgcggtagagagatcacagaaatgaaaggaagccagttcacacagggccatgtaaatctccagattttacttttaagatgggaagcctctgaaaagttctgtgcatagtaaataacatggtttaactcagattttaaaaagatcattccggctgctactagagaatacactgtaaagcacaagactcctgggaaacaatttctttcttttgccaaaagatgatgcctttaaacagagtaaacagaagtataatggttaaaaaaaataaaatgaattatgggtatttggaaggtgtagccaacaagatttaccaataatttgagtatgtgacatagagaaattaaaagatgcttccaaggcttctggctgcacaggaggggaaaaaagctgttattgactgagatggcaaaatattatgagagacgtaggtttgggatgatgaaaatcaggagctccacttaggacaggttaagtttgagaaccagacttaactgttggataaatcagtctacagttcagagggcaagagctgacgatggaaatagaagagttgtcaatagacagagtcctggggcatttctgacatttacagtaaactgagcatttattaaaactaacttgctttactgaaccataaatcacttgttgtatttacccctgctccatttatagttatacatctggaaacatagccttagtgttagaggtaaagagtaaataccaaacataaaaaatctgatctggttgggtgcggtggctcaagcctgtaatcccagcgctctggaaggccgaggcaggcagatcacgaggtcaggagttcaagaccagcctggccaatatggtgaaactctgtctctactaaaaatacaaaattagccaggcatggtggcacatgcctgtaatctcagctactcgggtggctgaggcaggagaattgcttcatcctgggaggcaggggttgcagtgagccaaattgcgccactgcactccagcctgggtgacagagcaagattccatctcaaaaaaaaaatctgaagttactgagaaactggtatgaaatcattaagaaaactaaggtgtctaaattaatacatacaaagagattctacaacacggtatttataaatttaaacaaaatccatggccaggcacggtggctcacgtctgtagtcccagcactttgtgaggccaaggcagaaggattactttggggccaagagttcaagaccagcctgggcaacatagtgagaccctgtctctacaaaaaacaaacaaacaaacaaaaacactgttttagcctggcatggtggcacatgcctgtagtcccagctactcaggaggctgaggcatgaggatcacttgagcccaggaattcaaagttgtagtgagctctgatcacaccactgcactctagctgtatcacttatgacagagcaagacaatatctcaaacaacaagcaaacaaaacaaaaaactaaagtaaatccaggtaaaataaacatacgaataaatgaaaagatctgggttattgcattagttctgtttctaggcttaactacaaaatggtgtccagttgttaaaaacacttgtttaagagtattaataatttttttttttactatgctcttctacatcctaggaaattggcaacactaagaattcctaaaaacaaacaggagtgttaactgtatataaattattatttaagatgcattcaaggcgttacttaaaatatcaaatgcatgtcaaagtacaaacaacaaaatcatgcttcaacaaatgtgggatgttgccattaatggacagttagctctgaggtaaaaccaagaatccttcattacctatttttgtaaattaggacaaatactattaaggtattaggttggtacaaaagtaattgaacaaacctggacccactcacctcactgaaagtgctgcctggctacagtttctagatataggaatgtgagaaatggtagcagccttgaaggtttagagctatattcccataccaattatggctagaaacttaaaacagctctattgagacattatgggaagtctaatttcctgttactctactttaacacagccaagtaaaacagtaagaaagcttgcttaattcaacaaggactgagtgccagagtgtcacctggaaacttgtgacaaataatcatgcctcacacattcatccttggtttttactaccaaatgcaagcttcatctatcctcttccattctaaacttgactcatcctcctaacctcttccagaaagatctctagaaacccagaggctttctgaagacccataggctatcccccatcttcaactactttacataatggcccctcaacttcttagctttcatgaaagcctggctcctccccaaaggcactgcctatcatgcaacccttttatgtgactcctaaaactcctaagtccaccattattcttctaattccctgtattaaaaataaacggcaaaattccctgtattaaaaacaacaaaaaaacagcttgtaatttgaaactcatgtcatctaaccgaatgccttctctttccctccctgttctggtcaattaaacccacatatttaagcctccactttgcccccagttacatcatcagcaaagtgacttcaatgtccctgtacatggttctatcccaatactctaggcccccaaaatatttgcctttctaaatttgagacatcttcacctcctcatttcagcaaatcactcccttgtctttgttagacatactaaaacctctgacaatgatcatctcagctatctttgtaagagtttcactcatactcatatctcctttcacctgtcaagacaccaggtttggtgacaaataaaaatgatacgtatttgggaggctgaggcaggagaatcatttgaacccaggaagcagaggatgcagtggccaagatcatgctactacactccagcctgggtgacaaagcaagactctgtctcaaaaaaaaaaaaaaaaaaaaaaaacacaaaaaacaaaaaaaaggatacatatttattgtattcacatgatgttccaaaatatgtatacactgtggaatggctagatcaagctaattaatacatgcaatacctcacatacttatattttatggcagaacatttaaaatctactctcagtgatttccaaaaatacactgttattaactagtttccatgttgtacaatagataccttgaacaaattcctcttaattgaaattttgtgtcctctgaccaacacctctgcaacccagtccactcacccccagcccctggtaaccaccattttacatccctgagttaagattccacatttaagagagatgtagtatttgcctttctgtggctggcttactttcaacaatgccctccaggttcatccctgctgtcacaaatgacagcatttcctcctttttatggctgaagtatattccactgtgtatacataccacattttctttatccatgaacacttaggctgatgctgtatcatgggtattgcaaatgataccgaaaggaacatgggagtacagatctcttcagcgcactgattttattcttttatttatatatatatatatatatatatatatatatatatatatatataaaaatacatatatatccaagtgtgactgctgaatcatatggtagttctattttttaatttctgagcaaacgtcatgctattttccataaatgctgtactaatttacattcctgccatgcgcaatatatctcttgtctgcaaatcctcatcatactttaatagccattctaatggccatttgtatgtcttattttgagaaatgtctattcaagtcctttgcccatttcttaagtgaggtgctttcttactattgagatgtctgagttccttatatattttgcatattaaccccttaccagatatatggtttggaaatactatcttccattctgtgagttttttcattctgtagattttttctttttgccatgcagaagctttttagtttgatgtgatctcattcatcaatttttatttttgttgcctgtgcttcgagggggtcatatccaaaaaaatcactgtccaaaccaatgtcatgtacatttctcctatactttattctggtagttctacagtttcaggtcttatatttaagaccttaatccattttaacttgaatttggtatatgatgtgagatacaggtctgatttcattctcatgcatgtagatattccattttcccaacaccacctattgaacagacttccctttccccgctgtgttctttgcaccctgtccaaaatcaactgatagtacacgaatttatttctgtgctctccattctgttttgtgggtcgatgtgtctgtttttttgtttcttttgtttttaaaagacagggtctcacgctgtcatccaggctggagtgcagtgatgcaatcacagttcactgccaccttaagctcctgagctcaagcaatcctccttcttcagcctctcgggtagctaggactacagatacacagcaccgcgcctggctttaaaaattttttttttttttaattttagagacagggtctcactatgttgcccaggctgctctcgaactcctggtttcaagtaatccttctgcctcagtctcccagagtgtgggaatacacgtgtgagcaactgtgcctggcctgtctacttctatgtgactatcatgctgttataattactgtagctttgaactatattttgaaatcagatagtgtgatgtctccagctttgttcttttcactcatgacagctttggctatttaggatcttatgtggttccatataaattttagcactgttttctagttctgtgaaatttaacattggaattttgatcaggattgcattaaaactgcagattgctttggataataaaaacattttacaatattaattcttccaatccataaacacaagataactttccattatttgtatcatcttcaatttctttaatcaatgttacatagttttcaactctttggttaaagttatttctaagtacaatcatccctcggtatctgcaggatattggttccaggatctcctgtagataccaaaatccatggatgctcaagtccattatataaaatggtatagtatttgcatacaacctacacacatcctcgtgtatactttaaatcattacttagtacctaatacaacgtaaatgctatgtaaatagttgctatactgtagtttccttattgtataagaaaacagtatttttattgttgtatttttttctcaaatattttcatccaaatgttggttcaatttgcaaatgcagaaccactgatactgggagccactgcatgttttgtttttggtacctattatacatggaattgtcttcttgatttttcttttagataatttgtcattaatgtacagaaattctacggatttttgtatcttgattttatatcttacaactttactgaatttatcagttctaacaattctctggtggagtctttaggtttttctatatacaagatcatgtcatcttcaaacagggacaacaatgtcttcctttcctactgggatgccttttctttctcttgcctaattgctcttgcaaggacttccggtactgtgctgaatagaaatggcaaaagtgggcattctcgttttcttcctgatctcaaaagaaaagcttttaacttttcaacattcagtataacgttagcagtgtgtttgtcaatatggcctttattttatagaggtacattccttctatacttaattttttaaaattttgtagcacaagagaatactgaattctgtcaaatgctttttctcaattatctcaattatctattgaaatgataacatggttttggcctttgttctcctaatgttgtatatcacattttatggattcaggtctgttggataatccttgtacccttgaggtaaatcccatatgatcacagtaaatgatccttctaatacactgttgaatttagttattattttcttcagaatttctgcatctaaattaagaatacgggtctgtaattttcttttcctggagagttcttgtctggctttggtatctaggtaatgctcatctcccaaaatgagtttgaaattactccctcttcttaaatttctcataaaattatgagaacaatctgtactagttcttctttaaatgtctgctagaattcagcagtaaagtcaccaagtcttgggcttcctttggtgggagatatttttatgactgatacaatccttgtcactggactgttcacatttttcatttcatgattaagcttggacaagttgcatgtgtctaggaatttatccatttcttctatggtaatcaatttgttggcatataattgttcagtctcttatgatcctcttatttcttgtacttctctggtatcagctgcaatggttcctctttcatttctgatttaacttgagtcatctctttttttcttagtctagctaaagacttgttgcttttatcatcaaaaaacacaactctttattttttttatcttgagtcatctcttttttccttagtctagccaaataacctgtcttttgagttcagattcttttgtctgcttgctcaattctgcttttaatgctcttttgcatttttcattccatttattgcattttcagcttcagaatttgttaaaaaataatttcaatctcaaaatttctcattttgattgctgttttcctgattttgttgaattgtttatctgcattttcttgaaattcattgagcttccttaaacaattactttgaattctttgtcaggcagttcatatatctccatttctttatggttggttcaggtgccttattgtgttcctttgactggtgtcacgtttccctgactgttcttgatccctgtagtcatgtgttggcacctgcacatttgaagaagctgagacttgttccagtctttgcagagtgactttattgggtaaagcccttcaccagtcagcctgtccagagattatgcagcctgagtctaccggggctggcctggagtctgggtcagcagggtaggtcctggagccttggtacacaggtgctgctggcctggcatcctggtctactagagtgagcctgaaccttggatctgcaaggaccagtgtgaaggctgggtaggtggatgttggcctagaatttggatcacaaggggctggccaagtactgggtttggacccttgttctgcagtgatgtgaggccacaggggccgatctagagggcagggctgcagggaccaccctagcactagacaggcttagagcctagggctgtgggatccagcttggtgctggggtgggcctccaagcttggtttgtgggtattggcctgaagtttggggccatgggggcctgcctagcattgagttttactggggcgagctcaatgttagggtctaagtctggtgtacacttcccctccttcccccaggtgaacagtctctctctccatgctgggatctcagggactgagggaggtgtgacacaagtaatgtaaaactgtccttcttacccttttcaatgtgtcttttcttatctgtgtgccacattcaggtaatctctcgtctggtttcttagctcttatatttttgtgtgtagacagttgttcaaattgatggttctacaatgagatgagtgctgcaaagtgctagtctgccatcttgctgttatctagacctcaggcttttcttaaaacaactcaacactttggtctggcatcccaacctttccaatcatggccatcatccacagcatataaattcaaatactccaatgttaacatcttatgcacatgccactaatgattctgttccatcagctctgctaatatccaaccctaaaataccatgcataatcttctggctattggagaaaagtctttaaatttcaaatgtgataaagtctttaatcttaactagtcactcagtggaatgagattctcctactctgatacggtttctgatttcaggtagccagccagtcaagactctcaacttctgatccacttcttcacccattcccctcagtagcttcctaagttttcagtcttctcaaaacctctaaacaaaccttgtattccacaaaatattattaaaaaatgtttcataaaaagtttcgtggtcactaacctacagtaacatactaccttatatccactacaatgactactattgaagtacacacacacacacactctcacacaatatgtgatggcaaggatgtagagaaactggaccccttgtgcactagtggtagaaacgcaaataggtacagttgctctggaagagtatggcagtttctcaaaattttaaaaataaaattaccatatgatccaacaattccacttctgggaaaacaattcaaagcagggtctcaaaaagatatttgtacactcctgttcatagcaacattatctgtaatagctacaacatggaagcaacctgagcgctcatcaacaggtaaatggataagcaaaatgtggtatatacatacaataaaacattattcagcctgaaaaaggatgcaaattttgaaacatgctaaagatggatgaaacttgatgacactgcgaagtaaaataagccaatcataaaagggcaaaaactgtatgattgcacttatagggggtacttagagcagtcaaaattagacacaaagtagaataatggttgtcagaggctgtgaagataaggaaatgaggaattattgtttaatgggtacagagtttcagttctgcaaaacagagagttctgatcgtgactgtgcaacaatattaatatacttaataccattgagccaaatacttaaaaatggtgaaatggaaaattttacattatgtgtattttactacaattttttaaagcttaaaagacaagtcacatggttgggtcacataaatttgagaaatacattttatagtcgtttcttgcagattcacaatatataccggcatttaaataaggttccaatattttcagtaaaaaaatcttgatttttccaccctcacccacaattacaattaatatcacacatccatctttacttccttgttctaatttcattagatgggcatctttcctcttattcaaggtcaatcactatatctgcatttttctttttttatattacctgtatgagagatacacctgtatttttcattccaacccttaatacctcgaaaaactttgctttgataattactacctctattatctgaaacatctttagtcttcacaataaatcactaaagtcttacttacttcatgtcctaaatatttgtcttaaatccagaaaaatttattttgaattcctattataccactgtcattgtcaaggctctcactgactgaactaccttaccaccacacgtttctcttcaatcctttctctcttgcaaggttattaaaaatacacgtttgacaaacttactatctacctactgagcaaattctttgctgactccctaataccttctatcacatcttatcttcttcattttcctacctctcagctagtttatgatctaaaagtcctcaactgcctattgtcccctactccctatgctgcttctaactttggctcatacttctgcctggaataagccgctcatgcttctagctgcctgattcccagtcacatttcaagactgaacttagcatttcctggccactcttacttccctgccatctacactagattcctattgcatacctgggtactccagtactccttcatgttactattgtattttggataccattctacctcagtgactgaaattatttgcttctgcatctttcactcttgagtataatataaatttctgtagggtgaaaactaattattacgcatctctgtatctataacatagtacttgatgccttaaatatggtaggcgttgagactgttaaactcaactctttcctcaacctccctatttccctacaactgctaccagggaagcaaaaagactaagaatttaggcgtgtgcatttatctatctagtagtagaaacctagtaaactgttaccgaggtttagagttatctgataggaaaaaaagtaggtatgttcctatctcccatttactgctaaatgattcctttcttttaaccagaaattatttccaaataatgtgacgtaatttaaagcagtctagggcaactcaaaataagaaccacagtctcaaccaagttacacttacattcggctagcttcaatgtcgtcagactgaggttctcctgatctgtaaaatgcaattgagaaacagttagcaaaatattccatattccaaaaaaaaaggtagacatattacttaggaagacaattttgtaaacaagatttaagcactaaataaaacagttttaaaattaaagatgtcaacatgaaagaaagtggtcagatcaggtggccatacaacacatttattttaagggttggactattaaaaaactcaatgcatgttttttaaaggaaactgtaaacgctatacatagataccaacagacaagccattataagccataattattcacaaagtcaaatacgtgtaataaaacacacaactaaaaaacttcctatagccaagtattggttatccacattaacaaaggtactcactggtattcactcacagtattaaactttagattagtggctcagtaaactactccctaggcagacagactaaagcttaggccagccatgtagttttgtaaatgaagttttattgggatgcagccatactcattcatttaggtatcatctatggctgctttcacactaaaagaacagagctgaggacttgtggcagaaaccacatggcccataaagcctaaaatatttattttctggccctttaagaacaaatgtgccaaccgctaccgctactccagacaattcaaactaaaatctaataccttggtaagtttaaagacacttaaatcagatacaacattctaatgatgattatcttggttcaacaatgaaactgtttccctaaaaatacacttactgtatgtattacctgtcaaaagtgtatcacctgaggtgaagttttgcactggatagctgtgaattaacttcagttttaaacagttgccagttactttgttatttctaaatatactactgctctctcatgtagaaatatttaaaattctaagtcactaaaaagcctttcattttcatttcacgagatatgaatcagtatttccctatctattcacttttataaacagcatcagcaacaatgaatgagtcaatataatattgatttctaacacttagaaattcccaaactagataaaaaatgttttttgaggtcaaaagctaaattttcaaattggcattacaaagtcctgatttgtgaacttctcactgactttaggcttccaactttaagcaactctaacaagaatcttaaaatcagtcacacacacacacacacacacacacacgcacacacacaaacctgttttctaaatttcttagctaaaaacaaaaacaaaaacaaaaaacaacccctcacttctttatcagactctcaaaattaccctcactgcaattcattcagattccaaggacaagaatggaaaaggaaaaaaaaaaaaaaaaaagactccagcagctcaaatatttattttagatcttctttgcaatgtatttaaattttcaattttgcacaaaattacataacaactaaaaactggggcatgctggaggtggcagtgacttggctgtgacacaaatgcaaaaatttcactccaccctctcccccagggagcaagcaaatcacctatgtgacacacctggtctccaccagccttgtgggtaagtaccccaagattgcttccaaacttgtatctcccagacagaagagctaaaaattgatgataaccccatgtaccagctgactcatttttgaaagtgcgaccctccagcatcagatgtcatactgtaaggaggcagagctggcttgcaaaacaaaaaataaacctgctggcactgagggaagagaggcagattagaagttttcaaacacgtaggcagcaaaactttcaaaattaacagggaaagagaagagagggaaaaaatgaggacatgatgataggaaaataaaaatattactgcaaaaaggtaagacacaagaagaaaaacaaatctaagtcttagaagtacaatatgtaactgttacaaagttttgagatcctgaaatgggatagagtttaaatacattatcaaatgataactacatctatcttcccaatttctgttccctaagcaagagaatatgtgaactttggcatcaaaatgtttgccaccaaactgtaacatattaattactactttttacatatattaaagtaggctattaaaaaccattgataagacaagctaagtaatttaaaccaatccagtatagaagaagaaggattgaaagattattaccttaaaataaatctgtcctgggtctattaaacatagcaaagttgttctactcaaattggaaattgttttttaatcaagagaaaaatgaatatatgcagaactagcagacatttttcttgcagtaatttataatagtttctgtctgaatgaatttctactcatcctaataacagtatatttctagaatattataaataagttaccaaagtcccgaggttagaattcaaactctcaaaactatgacatatgccaggtgtggtagttcatgtctgtaatctcagcactttgggaggtcaagacataaggaccacttgagctcaggagttcaaggtcaacctgggcaacatgatgaaacctcgtctcttagccgggtgtggtggtgggtgcctttagtcccagcaacttgggaggctgaggtgggagggtcacttgagcccagaaggtcaaagttgcagtgaactgtgatcgtgccactgcactccagcctgggcgatggagtgagaccttgtcttggaaacaaacataaactatgaaatatataccacctagcaacagttcccaagcttgactttggctcctaaagagtctacttattcttttactgccaagttgctggaagtaagaatcctgtatgtgcttgtaaatgcagaacatataacctaattcaaaacatataaccaaagggaaatttttgtattaaactattgacttaggttatcctaaagtgtgtcagaataacaagtcagaaattttaaaactgaaacaataaccaaataacattggataataaaatgtaaatctcagaatgagaatcaattttaggtcttgatttgaatcgcagaaaatatgatcacaaaacacccactaatctgaatactgcagcatgagctagcaaattcaaatggtggctcacttccaataacactggtgcagcttctccatcctgcaagccactccttttacctccactgtaactctctaggagagaaaagtatactagttttattaatgttataaaaacttctagagaaatgtttagttaaaacgttcaccacataaaaggcatactttaaaatgcatattaagaaatttttaatgttttctataatgtttatagtaaaatgtttaaaaccttgaagtttttttgagaaatactttcctgtttatacatacagataggtctttgatagtggctactgatatttttaatgagaaaaaaagacactaaaatattttaaggagattaaatgaagtaggtcaactctcaggcccactattcttagcagtattcctgccaactatacattgtcttcatttttacagtatgtatttcactttacaatgacagccttttaaaggctgtaaaataattcaaaattaccttttacaagctgtggccattcggtgacatcagggtgatcacagctttgagtcactgattaaaaacaggttgtcacaccagtctagctgctaccttgatctgagcgtaggcttaataactctaataaattaaacaaacctttggttagaacactttaatatataaacccaattcattgttcaaaaaataatattcaaagcttcaaattaggtgtcaatgtaaaattcatcagaagagtaattattatagaaaagtttttaaggactattttccagcattttgtttttcttaaatgatctcttcatttgagaaaatgtaataattccttgtacttttatgtaatgttatagtttctgaagcattttggtcaatagtaccttgagtcttataacaactttggctttacctaatcaagacagataatatactaagaattaaaaaaaaaaaaaattaagcagcctccgagtgattaactgacttgcccaagattttggaactagtgttgaaggactgactaaaacccagatatactgacttcctatcaagggatggatttttttgtttgttttggcttagttttgctatactgggtttcaagatttaagtatatgtaaatgagtaaagattcagaacacagattgagatctttcaaatacggacaaattcagtcaaaagattcctaagctgatagagcaatcagtcaccaaggagggcaactgcttaatggaatagttatatacatacacataaacacacacacataaacacaaagtctagtcccactaattctgtatgtacgtaaagtcatttaacatcagtcaccgcatgttctcactcacaggtgggaactgaacaatgagaacacatggacacaggaaggggaacatcacactctggggactgttgtggggtggggggaaggggagggatagcattaggaaatatacctaatgctaaatgacgagttaatgggtgcagcacaccagcatggcacatgtatacatatgtaactaacctgcacattgtgcacatgtaccctaaaacttaaagtataataataataaaaaacatcagtcaaaaccccttaagtactgcataaaaatatattctactctttcttggccataaatctactaagatttaatttcatgaaaaagtatggcaaaagatgaaagcatatcctcctccctcaaccaaatatctttttaaccccttacatggccttagctgaacttttctgattgtcacagttcaaatttagcaggcctctttactgacactgtagttctggcaaagataccatacatctgaaatatcccagtatcaaaagatcattttgtgcaactagttctttcccctcacgattcccctatccaggccaaatctgaggcatcaactacggaaagatgaggaaattaggaggaagaaacctttcataattaacatcctcaaagcaacaatagtcaagcgtaaaaggtggttaccagtgtggattcagaacccaatataaaacagcaaggtatctgcgaataccaacggttaaaacatgaatgtttgagcccatacctatgcagctatgaacgcagggcttcaaaatccagattaggtgaggattggcctgaatatataaaaataattgcaggggattccaataaatgggatttatagtatctgtaagaaataacgcaatctcccagatactcctatcctaactatacattgcctaataagaacttagacattgctgaggtcatatgggaaacaccaccttccctaaaataaacaatgtggtcatgatacagcttccccttgggttctcaagagactaatggtatgtggaattagaagattcaaacaagtctaactttccatcttgtaaacacaaaaataataaagttaaaatatcttttaattgactaattgacctcaatgtaattaaagagctatatgtattttgaaaactagagtcaagtcctctcttccagtcccctcttttatgagatccggtgctcaaaaggctccaaggccaggctggacttatgtctctgtttggtcattcactagctgagaaatcttgggcaagttacttaacctctccgagtctcagtttccttataggtagaactaggataatagtacctattccatagagctgtcatggataaacaagctaacatctaagtatctcagaacagtgcctgacataatgtgctcacaaatggctgggcgtggtggctaacgcctgtaatcccagcactttgggaggccaaggcgggtggatcacttgaggccaggagttcgagactagcctggccaacacggtgaaaccccgtctctactaaaaatacaaaacttagccaggtgtggtggcacacgcctgtaatcccagctacctgggaggccaaggcatgagaatcacttgaacctgggagatggacgttgcagtgagtcaagaaggtgccactgcactccagcctgggcaacagagcaagactctgtctcaaaaacaacagcagcagcagcagcagcaacaacaacaacaaatgaaagctattattaatactcatagcccaaaatccaaacctgccctctcaatctttttatgcatattattttacctctcatagcacactaatctcttgtaaattttttcagcaccctacctgggtccctcatacagtcttggaagtgtagttagtgagcacctgacacaatgctttaaaaatggcaggggcccaaatttgctgaacacatctgtcattattatgacattaagatacacatgcaatacgaattccaaaaaataaaacaaaaacataccatatttcgccaaacttctgaggagctggtgaattctaaaatcaggctcttacagatttttaacctaaaatataaaacacctcactcaattctttttacataaacaactggatgaactttcaaaaaaaaaggtactaaatttcatcataaaggcaaatttattttctataattatgaacatccaaaaacgtatcaagaaacaaattactgctgttgccgggatgaggaaagcataggtaggcaggccctgtggcctgagtgctttcagcaggcaaagccatatttcccatattcatccataaagcttagtgccttctatttatttactctatcctccctccaaaagggctaaacacatatgaaaactatttgactatatccctctaatcctttcaaatacctatagcaattttgtttttaattaaattctatatgctaagcatcggctatgttaggtacaaatctgggcatctaccactttctagagtagcagccttgggccgaccctctgacccttgagtctccaatgtcaggttattgtagcagagaaaatgcgttaaaaagttatagtataatgcctacctggcacaaaacaggacttcaatatacgacgataattataatttattaaatcaaccacttaatatatatcaaaacttaactcttaaaaaaaaatcctgaagcttaaagcaagcccctaaattatcactgtaaattcttaacttgtttgtatacaatcagaacattcctcaatggaacaaaaataaagtcctttcatgtactgcattacatataaagaaagcaaatctcaaaggttaagaaacctatccagtgtcctagaggttgatggtagaaagtgaatacactgcatataaaacattttgaaataaaattaaccaacttttaaggttttagagactgactttcaaacttcagtctataatagaattacctggggaaatctaaaaatgcaactacttgggctctactcgcaaagattttcattcagtgcatgaagtaggggtaaatgaattttttttttaatttttttcagaccaacccaagaacgcagaaatgaatttgcattttaacatatacttcacatgacacacagatctcattttaagaagccctgccttccaaattatgagttaggaacacataatcatggaggaaatataccaaatctataaaaatacagaataacaaaaactgtaagcactacaaatattaggcacactcacttgccaatttaaccataagaatcctaataccagacatagttctcttactttatctcttcaacagagggctcagtctaataatcttataaataagtatagtctaataataaatgcctatgttgatctatatctacctccctaaaattttcattttattcatttctatttttccttcacctccttctaaagctgtttcaaaacttaatttcacaaactgtttttttctatcactttttattataacacccaacacttctgttctcctttgcatcatgtttatggtgtcttatatttatggataatgctacttattaaaactgtctaagttttgtccgtttacacatttcacaattaaaggactactacaacaattttcctaagtcctcctgctttagtttctccttattccagtccattctgcagttaagacttaaaaagttttaaatactgctttcaaataatacttgcaacataattccctcaactccattagctcctcagagtaccatttctttatcttctttccttttactgccaaaaagacgtgaaaaccactagctcagctgctatttttctatctactgaaatttttcttgtaaagtttccatcatttctgtatattcccagtgctttggccccttaatcctacttaatttttgtagcttttaagactgctaatgactcctcacctcctctggcttccctaatgttgtatccactcattttcttccatctctctaaaggcaataaggtcttctgctagttcatcttcctacctcatacatggcctctctccaagtttctgtcaatagccacttttcttaacctaaaccaattttctgcgcaatgtcatccattcccatagcacctctatgcttacaaacccctaactctgtatctttaagtccttatgtctggcatggtatgcctgcaactacatattaccaacggtacacatccatttggatgtctcattaacatctacattcaacgtatctaatatcaaactcaattattttcccaaagaactcactctgcctaatctcactgtcctggttaaggactaaaaaaattggtgccattcattactttctccccctcatttttatttgccctaaccactgtgtaggttgatacttgttcagccttcaaattcttcataatcattaattcaaaaactgtctactagattttgagtgcctactaggtggatgaagatgcagaggtagaaaaactagacataatttcttgccctcatgtggtgaaggaaatgggcacaaataaaaaccacaattaattatgcaataacaatgcacagttaagtgttgtgatggagagatacagggggtgttaagttgtgtactgtaataaaaagtccttagtctgaagaaaaggaaaaccattctttatgagggacaagcaagatttacaagacacactaagaaaaaccctgtgaggtaatgatggtagcactatcagtccagctgctcaaattggaagattctcagtcatattctaaagagtctctctctttcccagtatatcaaattgtttaccaattgctaccaattcatccttagaaattcccctacatttctacattctcacattattccccagtcttttttgattgcttttagttgcttccagaataaagccaaagctcccaatcacgtcagatgagattctacacaatttggtcaaaacctgccagtgcagcctcttcttacagactagaccagacttcaagagaacatgtgtatcatttgcttttatacttccagtgcttgcaaatgtttatagaataagcatcttacaaaagagaaaatttttctcttagggaactagctttcagtcctttagtaaatgcaaggttaagattcaaaccctaatttgtctgattctaaagaccacgcttattcccttgtacttgccttctaatttatactcaaaccctatgaatttccttaaaaatatctcttactccttttttcctcaaacttaccaacactgtcctactacagtgccccattatttcatctggtttcccttttgcctttatcctcaactttgccactagaattatcttcctaaaaactcaaagttacacatatcattctatattcaaaagctttaacactttctcatgccaacagaataaatttctaactccttcacattttatttgaggcccctgccatgtggccctgaccccagccatcccagcactactgcccactatatgacatcatcaccagttaccagatctagtcccatcatttgactattggctataatgtactggatatttgtgtttctgacttcaatgcttttgcttctgaggagacttcactcggaaatggtcctctatccattactaacctctatcccccacccacctatcatgccatgttaaaaactggcctcattctaaacactgtatctcacagggttatctaaactcttatacataatcaccatctccttcatgtcttattatacattcttaataccataaaataatttattaatttctccttatatttattatgttataccttacattacagctatctgtatacatttgtcagtgcctctagttgtaagctgattgatggtagggatcatctcttccatattttacttttcgtaataatggtgactatgttttcttgacaccatacctcccctctacaagaaaaaaaaaaaaaaaaaaaaggaatcaggacccatggcctttgagctagttccaaatgtgactcatagatgaacaaagataccatttcttcccaaattaacacaaatataagtaaatgccaatttaagaaacgttttttcaaagactaaatatgtaagaataaccaaaacaattgtttctaataatgttcctttctctaccagatattaaaacatattaacttaaatggaataattaaaatcggcatgcctttaaaaaactgagtatacactaaatatatgcataccttatgacttaaaaatttcactcttaagtataccaaacagaagtaaacatattcacaagaagacaatcactgaaatgtttagagcagcagcaatattcttaacagttccaaaccaaaaatgattaaatgtccgtaacagcagattaaactatggcatattcttaaaatggaatatcacttccattcttaaaatggaatatacagcgactatcataaacaattactacaaccaacaatgtgaataaatctcacaaatacattaaaagaagtcagacacaactaaatgtgcttgattctagttaaaggatgaaaacaggcaaatctaatctatgctatgagaagtcaggacagtggttacacatggaagaaaaggggtagtgacacagagcacaaggggctacgcaggagctgctgctgttttttgatctgaatgctagctaaacgggtgctcagtgtgtgaaagtgcaacaagctatacacttagaagtgtatagcttaaaacattctaaaaaaaaaaaaaaaaacctcatatggtattagcattagacaaagaggtaagcacaacaagcacaacagaaagctaatttcagagaaagatccgaaagtatctgacagttgctccttctcaaacgagaattttcagaccttggataacaggcagcagaggactataatgcatgaaaggacaaaaacaaaggaggtgagccatccactgcttggatgtctgcctggaggtaatttccaacctgcagtcaatggaggggaaatccagtgagaagacagcagttttactgagttcagaatcaagagatcagagctgagaaagctgaagtgggtaaaattgatgacaagtgccagacaagtgcttgtctgagaaggcagagaaatggcttcagaaatctgccatttgagagtccactgctgagtactaactgtacacgattaaggtaagtgactccatgaagctagtgaaagaggggcagtaagctgaaatattcccagtacttataaaggactgggagactcctaaaattctctctaacctgagtgaagagaacacggtgacactgggagcatttagtaaagactcagaaggatcatgccttaggtaggagctactaccattaaagcaaagccttctctagacaaactccaatgtagccctgaagggataaaactgaccagcaagttatttaggtggctacaaaacaaaacactctaaaagaaaacaaaatctagacacccaacaacaaaatattacaatgtccagcatccaatcttaaaaaatcattaaatatgtaaaaaacaaaaaataaaataaaataaatactaggaaaatacaacccatgaccaagagaaaaaaccaaccaacaaattcagagtgaaaaaattcaagaaatcaataagtaacctgattttcaaacagctattacaaatatgctcaagaattcaaaaaaatacatgaataaaatgaatcaaatggaatttcttgaaatataaagcgaaatatctgaaattatttaacaagggaggagaaaaaacagtaaaatagaagacaaagcaaactgaagcacagggaaataaaaagactgaaaaataatgaatatgatgttaatgacctgtggataataccaaacagtctaacatatgtgtaactggagtcccagaaaaagaggaaatgatgaaagaggagtaaaggtggtaaaaaatatatatatagaagaaacaatggcaacaatcttccaaatttaaggaaaaccataaatgtacagattcaaaaagaaaaaaaaaacaaaaccccaacaactctcagcatggtaatcattgtgcaaatatcatagaacgtacttacacaaatctagattagatggtatagcttactacagaactaggatacatggtatagcccgggtgctcctaggttataaagctgtacagcatgttactatactgaatgaatactgtaagcaactgtaacaaagtgtaagtatttatacatctaaacctagaaaaggtacagtgaaaatatggtggtataatcttaaatgactattgtcaactatgatctcgttgactgaaatgtcagcatgcggcacatgactgtataaccagacttctcatcaaaaacaaatgctgaaagaaaaacacatcaactaaccaagaaaaaagaaacatatatgtccacacagagacttctttttttacacaaatgttcattgtacctttttataatagctgggaactgaaaacagcctggaactgaaaacagcccaggtgtcccttaacagatgaagtcacaaaccaccgaaacattcaacaatatggatgaatctcaaaaacattatgttgagcaaaaagaaactttttacaacatataagtattgtatgactctacttacataaagttctgcgcaagctaaactaagatgaaaacaatctgaacaatgttaggttctaggggtggtgtggggggaaggaataactaggaagaggtgtaggttctataccctgatagaactttctggcaaaggtgtatacatttgtcacagctcatgaaatggtatatgtggtcaactgtattttccaaagatggtcacaatagaagccattccacatgctcttaacaatgtaacactgtcattttttcatcaggtggtggagtctatggcccttctccttgaatctgagtgaaattagtgagtctttcaatccaaagactacagtcatacctcaactatctacagaggactggttccaggactcccatggatcccaaaatccaaggatgcttcgaatcccttatataaaatggcatggtatttgcatataacctacatgcatcttcaaatatgttaaaccatctctagattacttataataccaaatacaatgtaatgctatgtaaacagttgttacaatgtattgtcaaagacaagctctccttgccaatccctgaccaaatgagagattcatgagcaaaataaatagttgctgatatttaaggcactaagtttggggcaatgtattacacagcaataaataactggaacagcatagtaaattctagttaaaaatactaaactactaagttttagttaacatacatgctcaagttaagggtgtggtatactaacaactgcaacttactttgaaaagcataaaaaaagacactagaagaagacaggatggatagatggacaagatagaagacaataacaaatagaacaaaatgttgtgaaattatattctacaattattttaaagtctgtgtggtttgaaaaattgtacgataaaatgaagagtgaaataaagacatttccatacaaacaaaagctgaaagattttgtagccagtagacctatactttagaaatgtttaagaaattttttcaagtaaaaggaaaataacaccagcaacaaacttggatctacaaaaaggaatctccacaaagaaaaataaataaaaatggtaaatatgaaggtaaatataaaggaatgttattcttagtttttaagtttcttcgtaagacaactggcctttgaaagaaatagtttcaaacgctgctgtggaatctataacacatatagaagtaaaatgttaagatcataataccaaaaagaatgagggagagtaaatggatgtatactattccaaaattcttacattatacattaagaggaataatatttttgaaggtagattgaggtaagttaaaggtgcatattgtaaatcctagaagtatcactggggggaaaaaaaacagagggacaagctaataatggagacaatacaaaattccaaaaatgctccattaaccgaaaagaaggcagaaaaggaagaaaagattagacaaatagaaaacaaatagtgtcttaaacacaattatattgccaactgcaataaatgtaaatggacttaatcaaaaagcaacgatcgtaaaaagtcaatctgaaagcaagatgcaactatatgctatctaaaagaaagacattaaatgaccaataagctgaaaataaaaacacagcaaaatgatataatgtgcaaaaattaatcataagaaaggaatggatacactaatatcaaagtagactttagataaggaacattaccagcgataaacagagacatttcataatgataaagacatcaattaatcaaggagatctaacagtcctaaatgtgaacacacctaaggacacaactttaaagactttgcttcaaagcatatgaagaaaaaatgaacagagcagaaggaagataaactcaaaattatagttgaagatttcaacattcctctctcggtaattagtaagtggacagaaaatcagtaaggatacagaagaaatacatttatctatctgacaaagaacatatgttctgaaaagaatgtgaaaatatttgaacagacacacaaaagaaaacttctcaacagcagtcatgaagaaaatgtaaattaagaccataatgactttttacacccattagaatggcaattattttaaataaaaaacagaaattaccaagtgttagaaaagatgcagagaaattggaacccttattcactgctggtgggaatgtaaaatggtgcagtcactgtggaaaacagtatggcagtctctaaaaaaattaaacatacaattaccacatgacccagcaattccactcctaagtacataaccaaaagaattaaaagaagggactcaaacagatacttatataccaatgttcatagcagcatcattcacatagttaaaagttacaaagagtccaaatgtccactgacaaataaataaataaaacaaaaagtgatatatgcacacaatgaaatattactcaaccttaaagaatcaaatttggatacatgctacaacatgaatgaactttgatgactgatacggtttgaatatttgtcctgcccaaatctcatgttaaaatataatccccaatgttgggggtggggcctggtgggaggtaactgggtcatgggagcaatccctcatagcttggtgctctccttgggatacagagtgagttcgcagatgtggtcgtttaaaaagggtgtgccacttccccaccctctctcttgctcctgctctcgccatatgacacgcctgctccccctttgccttccaccatgagtaaactcaccatgagggctccccagaagctgagcagatggtggcgccatgcttgtacagcctgcagcaccaggggccaaataaacttcttttctttttaaattacccagtctcagatattcatttaaggcaacgcaagaatggcctaacgcaaggacattattattattaaatgaaatgtgccagacacaaaaggacaaaaatcgtatgattccacttatatgaagtacctggaagagtcaaattcacatatgaagtagaacagtgattaccagcagatagggagagtaggcaatgaagagttactgtttaatggatagggtttcagactgagaagatgaaaaagtttcagagatggatagtggtgatggctgcagaataatgtgaatgtactttatgtcactgaactgtacacttaaaaatagttaaaatggtatatttgatgttgtgtattttagtaccacttaaaaaaaaacactgcaatgggataccactacacacctctcagaacgtgtgcaattaaagactgagaacatcaaatgctgacatttggagaactggaactctcatacactgatgatgggaatgtaaagtagtataatcatctggaaaatagtttggcagttccttatacatttaaacataaacttaccatgtgacccagtaattccaatttaaggtatttaccctagaaaaatgaaaacatatgttcacacaaaaacatgcacacaaaacagtacctttattcgcaacagcctaaaactgaaaacaatttaaatgttcaccagaaaatgaatgaactgtggtatagtcatattgtatttaaaaaaacgaaacaaacaaaaatctgtgacaaacacaaattggatgaatctcaaaaacatgccaagtgaaagaaaccaggcatggaagagtacatgttacttgattccatggatatgcaattctagagtaggaaaactaataaacagatcagtggttgcctggggccaagagggagaaatgactacagacaggaaggaactttttggaggtaattcaattgttctaaagcttgattgtagtagcagtgatagtgtatatatttatcaaaatcaataaaactatatagttaaaatgggtgcatttcattgtgtatcaattatacatcaataaacttgatttttttcaaagtttgtgagaacttaatatagaaaaaggtggcattatcagtggggaaaggatgccttacaagacaatcagctacccaagtggaagaaaataaaaggtagatataattcccaaaccatgacaaatgcaatccagatctaaaccatatcataccatatccaaaaatatgctgaatgctcatatctaactttctaaattaaagtctataaagtaaaatcacaaaagtatcagaagaaaatacaagagattggccaggtatagtagctcatgcctgtaatcccagcactttgggaggctgaggtgggaggatagcttgaggccagaagtttgagaccagtctgggcaacacactgagatacgttctctaccaaaaaaaaaaaaaaaaaccaaccaaccaaaaaaaaaccaactagctatagtggcacatgtctataatcttagctacttgggaagctgaggcaggaggatcacttgagcccaggagtttgaggttgcagggagctatggttgctccagcccgggtgacagagtgagatcctatctctaaaaagtttttgtaatatatatatgagatcatatttatatcaactttgttagcatgctgaaacccagaaaccataaaagatggacagatttgcctacataaaaactttaaaatttcacatgactagatactataaaattaaaggtaggtagagataatatttgcaaattataataaagaattaaatgatatataaagaatgcttacaaatttaaaaaacaaacaccacaatagaaatggaccaaaaaaccaggcaatttcccaggttatttataaagacttaaacagattttatatatacatgaatcaaaacaaggtaaatgagcagtccctaatatattttaaggaatgaaacttgctaaaattattttttaaaaggtaattggcaaaacctatcaaatatttagattgacatgatctaatggcctgacatcttatttgtaggaatctaccttacagaaaaaataacaggtaccatcattgcaaaagcaaatattgaaaacaaccgaatttccaaaacaggcaaagggtctcataacatcatgaactctcagagttaattcctagttcagttctaaagattgagagaacacatcagatttagagtattccatctcaggtttctcaaggacaatttttcattaaggcctaatttattatattttaaaacatgcttttccatccttttttctgtttttcctcttttccccccacaagcttatatggtaaaattacctgtagttaagtgggcatgtgatatgatgcacagatttaatgcaataatttataagaattatccaactccattctctcagctgctctggtcaaaaaactttggcatcatgttttactcctccctttatttcccactttcatctggtctactaccaaatcctatggactctatttcaacatatatcaagaattcaaccacttctcaccaccctcactgtgaccactctgtccatttcagtcacgtcttaatctgtactaatggtctaccaattggtctgtttctgcccttgtcccctttttcagtctatgattaacacagcaaccagagtgaccttgctaaacataagtcatactttttcactactctgctcaaagacttccaatagcttcccatctcacttataggtaaaaatcaaacaccttattatgatcaaaatatctgtaccctccattctctctatttcccatcaattacttttctaaagctacactggccacacctcgagttcttcaaacacatcaggcactctcactttggggtttccctattcactacactctgcctgaaatgctcttcccccaaatatccacatggctagctctctcatctccctcagttcttcacccaagttaccatttcagtgaagttttctctacctaccctatctaaaatttcccatcatccttttcacctgcaaacacttcccttatttgtttcttctccttagcactatgtaacatatattttacctatctttatgatctctttttaggatttaagtgccatgaaagcaaaggactgagtgggttttatacactgctgtctctaccaggacctagaaaaaaaggcccactacacagtaggtgttcaagaaatgtttactaagtgaatcagatggatgtgtatgtagccaaccatttgaaagattcctataacacagttaagaggaaaaaaaaattatatgaaacacaagttttagtacacaaaaatctatgcacaaggaattaaaaacctgaaatgaaattttaaaaaattcaatttgcaataccatcaaaacataaaattcttagaaataaatttttaaagtaataagtacaagacctgtatactgaaaactacaaaacatgaaagaaattaaagaacaccttaataaatggaaagatatcccatgctcatgaatgagaagacagtattaaggtagcaatacttcccaaatagacctacagattcaacacaaatccaagtcctattaaaatcccagttgcatttttttgcaagctaaccctaaaattctatggaaatttgagaaacccagagacccaaaacaattttgaaaaagaataagttagaatactcacatttcctggtttcaagacttactacaaagctacagtaatcaagagtgtgtgttacccaaaaaaaacagacatacatgtcaatgaacataccttgaaaataccatggtaagtaaaagaacccacacacaaaaggacacatactgtatgattcccatttatatgaaatatccagaataaataaattcatagagacaaagcagattagtggtttccagaggccaggaaagaatggggaatggctgctaacaggttaggatttattttggggatgatgaaaatgttctaaaattcaatagtggtgatggctgcagaactgtgaatatactaaaaactttaaaagggtgaattttatagtatgtgaattatctcaataaagctattaacagttttgaaagttagagaatatgtttggtaggattttttttaaatactgcctccccaaaaggaaaaaagctgtatgtatatcagtacttttacagctatcttacattttatatttgattggtaatttccttccaggcatttttttccctctacagttaaacacacttaacaactgttaagttttagaattggctatgaagcgaagagaaacctttcatttcttcttatacttaaaaaaaaatagctttttatttttcttttctgtatttcctcatcctcaaaaatagattctacacaccaatatttgagggatggtggggcaactaccacaaaatacaagaggctctcttctggaaatgtaaaaatgttagaattcctaggaacttttcatgatttatgagcctaacctaacatttaaaactgagcccatgctggtaaatctgggctacacagtcatacatacatagaactctggaatcacaacacatccactgtgcactggaagagtactgtaatctccttctaatgtgcaccttggctctcccctcccttgggttctttgaaattttttttttaaataaggtatgtttatttcttatttacctactaactacagaaggtagactcacaatgtgccaatattaaaatgttatcattcctcattaaaatatttacttaagtgttttattacatgacttaccagcaatggaagaatctcatctgagagtagttctcaactgtcatctatgaaaatctttagaaataccaaatcatcagaattactttaatttcctggcttttaatcataaagcattcctactggtcaacaattctacaatctgaaaacagggacatctgtaccatatagtcccaatgatttattattctgaaattttcctctgggttatttttacactgtaattagagttcaaacttccatagcgcctagcctaaaattaaacccagaattatgccaatttatgcctgctatatatgcacacacaaaagacttataatgcaatatactaaaagaactaaaggtaggtgggtttttccttgaaggaatcatagctacattattttcaagtttaatctgttacattcacctgcctatcaaataaatgtagcacttaaacgcataaaacaaaatttgatttagtgacaaaaaaccattagcttctaatttaacttcaaaacgcttttcaaaaaatctaccccatctaattctaagtgaaccagaccacacttgatagaaaactgttgttctaaaaaccatacgtacttaacacaaacagtaaacatatgagaacatttagtcttctattaatgtcttacaaaatatttcaatgtggctggttataatttttttttttttaagggacagggtctgtcaccgcggctggagtgcagtggtgtgataacaactcactgcagcctggaactccagggttcaagcaatccccccacctcagcctcccaagctgggctaattttatttttcatagggataaggtctcactttgttgcccaggctggtctccaattcgtggcctcaagtgactctctcacctctgccttatatttccgtttgagctgttattatcaactggagtaacatttctagttggggaaaaaagaactgatccttatctgtagatgaacacttatacattcagcacttacaaataactgaatgtgggcatgaaaaaaagaatgacagatgataaacatttactgttctcaaaataaattacctaatctcagttgagataaacacgactcagaattcaattaacagtataatataaagaagccccaaaccaatgagtgcaaaaagaaagactctcaaggaaggcttccctgagtaatatttaggttgagccctataagatagaaggaagatggataactcaagaaactaaaagcagcctgtgtggtaagatggtactgaccaaaggggaatgcacaggaaggtaaggctcagaaagtagacagaaccctatcaaagcaaaattttaaatagaaagcactcttctatttcaaaataactgttatttgttcacaataatacaaaggaattataaactactaaaactaacaaaccaaagtgggcaacataggaagaccccatctctacaaaaaaaaaaaaaaaaaaaaaaaaaaaaacccacaaaacttagcagggcctggaggtgcctgcctgcagtcccagctacttgggaggctgaggcaagactatcgcttgaggccagggggttcaaggatgcagggagctatgatcatggcactgcactccagcctggggaagagagggagaccctgtctcctggaaaaaaaaaaaaaaaaaaaaaggtgggtggggtggggagaattcaataattaggacgaatagactttaaaatgtagtttatacacacagtggaatactactcagctataaaaataagaataaaaccctgtaatttgcaggaacacggatggaacaagaagccattatgttaagtgaaataagccaaacacagaaagacaaataccacatgttctcactcatacatgggctaaaaaagtatatctcaagaagataagcatagactggtggttactagcagccgaagtggggagtgagaggacaaaggcagaagaacataactgtatttattattgctgaactgtacacttaaaaaactgtacacttaaaaaatcattaaaaatgaactgtacacttaaaaaagatggtaaattatgtatgtatatttaacctcaatacaaaattttaaaaattcaatacttaatgctggaacaactagcttttcatatttaaaataaaaaatcctaactcctttcagatgaacctaaatgcaaataacaaagagtaacaaaaaatcctcaactattagcagacaatataaaaagaggatttcttaaacaaaaagcacaatcataaagaaaaagacatgatttttacatcaaaaattaaggctcatactaccagagaatactacaatgggcaggattttatattttactcttattctggtaactttctttggctgcactgtaaagtaagaaggttggatgaaatgatcttcatggtccttttcaacataaatgttgtacgatagtgtgcctttcctttaaaaacatttatttttgagatatttaaaacatacagaaaataataaatttcctatccttttacctacgattcagaataatcaagcaactgtaaattaaaatgagatagcatttcacatgcctcaaattagtaactattttaaaatctgacaatcccaagtatgggtgaggatgctagaaatgcccacataatgctgataaagtatacatgggcatatccatttaggaaaagaatttaccaatatctagtaaccagcaatttcacttctacggtttttcccaaaacacctgcacatacactcatgtaaaaataaacactgcagcattatttataatagcaaaaagaaaacaactcaaaatatccatcaatagtgggacacatacattttatctatgcataaaatgaagtgccatacagcagtgaaactgaataaactacatgtacacgcatcaacatatacacctcaaaaacttgatactgagtttaaaaaaatcaagctattgaaagacagcgttatacatgtctgtaaaaatttaatacaaaaaccaacaccacatatcacttacagatacatgtacacatgtatagtaaaagtataaaacaaggatgtgaaatttacttaagaatctcaagacagttgttactttgtgtagagacgggtaacaggacttgaacagttggggttgttaaaagtgattatataactgcatcctttcccccaagggataaaaatggacataatttatatttccaggtggtggataaataggcacttgctatgtcattttctggatgttttaaaaattttacaattaaaacatatacacttattttaaaaacaaacaaaagacatattagcatataatgtccaagctgataattaccttggaagattatctaatataaacctccctacttcactaaaaacaaaattacaaaagatatcagaataaaaatatgatacaggctggacgcagtggctcatgtctataatcccagcactttgggacgccaaggcaggaggatcacttgagcccaggagtcaagaccaggctgggtaatatagtgaaacttcatctctacaaaaacaaacaaacaaacatttttttaagaatgtaataggattggtgtggtggctcatgcctgtaatcccagtgctttcagaggttgaggcaggcagatcacctgaggttaggagtttgaaaccagcatggccaacatggtgaaaccctgtatctactaaaaatacaaaaattagccgggcgtggtagtgcacacctgtagtctctgctactcaggaggctgaggcaggagaatcacttgaacccaggaggcggaggctgcagtgagctaagactgcaccattgcacaccagcctgggcaacagggcgagactacatctcaggaggaaaaacaaaaaaaaacctatatatatatatatatatatatttatatgtattatatatatataatacatatatataagattatatatatattatatatataatacatatatataagattatatatatattatatatataatacatatatataagattatatatatattatatatataatacatatatataagattatatatatattatatatataatacatatatataagattatatatatattatatatataatacatatataagattatatatataatatatataatacatatatataagattatatatatattatatatataatacatatatataagataaatactattgtagcagggcaattttggacaaatactaggttatctgaaacagcactttggggaattagatcttgaccatttaagagagagattagccccagtttctcaaaatctggcactgactagcaatatggacaatgtgtgcaccgccctcgttccacctcccctcctaggaatgccatgtcaaattcagcacaggcataggcagtaaaactgacccctagttctgcctatcactatttaaaattactttaagtgttgaggactgtccccacagcagatatctaaaagtaggcctgaaagaactagaaagtagttcatgcatccagcagttacaagtgcctaaaactgtacatgaaaaaacaaaacaaagaaatgaactgagagcaaacatttactgttttcttataatcttcaatccaggatttaagaaattatttaatatcagttgagatacgtgaccaacccattctccagctgagatccatctatttttaaattcactcccccagcctttcattcagcctaaaagagggaataagaatgggaaggtgggaaggacttatcccatactgagttaaataagaccacaagatcttttcatttttacaatatttgaaatacagtacactgagcaataaatttaaagaaatatgcatgatttgaaatgcagaaatcttgatttatgtgtataaaagaccaaaattagctcagttcgtctaatacactacacttaagtgttcttcaatactacagtcaacttttcagaaatattcccattctgtgaagcaggatgtattcctaccttgattaccaaactttatccacgtaacttcctattctcccactctgttctttaaacatgttcaacatgttacagagatggcaaaatgtgttacaaaagggaatgagaatgaagcagcttaagtaattaggaaaactttacacttcttagaaactgaatttgaatgatcttaaacagcatattttcttttcttttcttttcttttttgagatgaaatcttgcttgcccaggctggagtgcaatggtgtgatctcagctcactgcaacctctgcctcccaggttcaagcgattctcgtgcctcagcctcccaagtaactgggattacagacgtgtgccaccacgcctagctaatttttgtatttttagtagagacagggtttcaccatgttggccaggctggtctcgaactcctgacctcaggtgatccgtgtgcctcggcctcccaaagtgctgggattacaggagtgagccaaggcgcccagcctaaacagcatattttcaatcaccaacacacaacatgaccactgacttcagaaaactaggaaagaaaaatgttacccaattaatctttgtgtgaaacaggatttatccattagtatacgtatcacataccatagatgcacaaaagattttttcaattcccaaaacaaaaacttaaaatatttagcaaagataatataaaaatccttatttatggcacgctgtaagattatcaatattggtgcatataaccacagaggcacaatagaattcttaggaaaaatgtattaagacaattaacaagctggaaataacccatatttccccttatgacccattagctttatatagaaaacactgctgtgcacttcatcctttgctttctaaagaacagcattatggttcacatctgttaagagacaaaaaagtatttgttggaagtacgaaaggaagaaattcctgtactgttacatgcagtgccaaaggaatcatctgagaagaaaataaagaacatgagtttaacatgagctttagagagggattacaagagtgcaagaaagtgacaaaatgtgacatatgtccatagtgaatacatggtgctttattgttttcagtatttctatatttaattaggaggtggaaagtttcagaatttattctgcatcacaaagattataaaaatatatgagttggggtgttggctacagtacacaaaggcaattctaagactacttattaacagaagcttgaaatggaaaagccatcccttctgatttcattacatgaaaagaacctgtgtagaagtacagcaatggtagcatcttcattcagcccacagctatgtaatttgtatgcaagagtgcttgtcttaaatatgaaaaggaacatcctgaattgctgaaagtatatacaacgggcacacatccagaactaggaaagagctaccaagcctgcatgctacgaagacatgggtcaaaaaatttttctcatgtttggtttctataactaaagtctgtgctagactaacctcaattgatcctgaggagatgaacttctggaacacacaaaactgttaagagtcacagcattagactctacactgtccagccaacagttttaagaaaaattttatcctacttgtatgagtgttcagggctcatatactacctctatgctcttacttgaaacacagatgcagaccttaataaataaagtcttacatcagactctcttctataattcacatgtgattccttacacgagattcctgttcagatttcctgaaaatgaactataggaataatcttatccaatatgattctatgtcccctaaaaatatcttttcctttcaggtcaatcttatgattcacttgccattgatcagattaacacaacaggtctggtacagcaaattacaaaagagatttgacttttgattaatacactgaataatgtatcacaaactattaagatccattgtccatgtcaaatggagttcacatatttaaaatgaattcacacactaaaaattccccaaaacaacgtttctaaaaagtttttttttttttctttgagaggcagtctcactctgtcgccaggcagtagcatgatcttggctcactgcaacctccgcctcccgtgttcaagcgtttcccctgcctcagcctcctgagtagttgggactacaggcatgcgccaccacgtccggctaattttttttttgtattttagtagagatgaggtttcaccgtgttggccaggatggtctcgatctcctgatctcgtgatccgcccgcctcggcttcccaaagtgctgggatgacaggcgtgagccatggcacttggcctctaaaaagctcttaatctacattttcaagaatgatcacgtttgaaaagcatactcttttaaaacaaagcaactatcactttcatttgacaaaagaaggaacgaaggcttcaaaagctaaataacctgctcatgaccattacgaagctagttaaaacaacctcaagaccaaaagacagtgctcattccatttcaatgactctgatgcacttaaaattttataaataatttttagggatatcagtcataaggcttagaatcaaatagtaacgactcatgtacaaagaccagtattttttaaaaatgctcagctgggcatggtagctcacacctgtaatcctagcaccttgggaggccaagccgcttgagaccaggagtttgaaaccaacctgaacacggcaagaccccatctccacaaaaaaattaaaaaataaaaaaattagccaggcatggtggcatatgctaatcccacctactcaggagggtgagatgggaggatcactccagcctgagactgcaatgagttatgacagcaccactgcactccaacttgggcaacacagcgagaccctgtctctaaacaaataaacaataagtaaaataaacaaaaagaaaatgctaactttacttcactctcagataggcctaataattaataagcttctttttgaattattatccataatggcatttacctgttattgataactcagatcaaagcactactaagcaacatttttgatagcaaatgaaaacaaaagctggcaaagaaactgtgtattaataagtcatttgattaaaaaaaaggacttggccaggtattgtggctcatgcctgtaatcccaacacactgggaagctaaagtaaaagctgaggagttcaagaccagcctgggcaacacagtgagacccccatctctataaaacaaaaatttttaatattatctttttacaaaggacttatttatatggcatcttcaagtatttcaaacatttcgtgtttggattatggaatatgtctccagaagaattaacactatttctatttaaggtaattttacatcatttcctttattagaagaaataacagatctgcagatggcattttgtgaaggctgccttctattaatagtgtacaaaacactcatatgtctccaaaaaggtgggtgagtaatcacaaagcaagtataactattcatcccaaaaggtaggacagaacatgtgccaatgtgtgcagagtcctgaactagagacatggactctggttctggttctgacacctgggtgactttaagaaaatcattttaaagctttgcactccaatttcctcttgtataaaatgactggagcagctgacctcatagacaatcctactcaggtagcatctatccatgtactgccagaagacagaatgataatcatgccccccaaaattagagtatttgaagacaactgccggagtaaaaattttaaattctatatacatacacacacacacacacacacacacacacacacacacacacacacacacacaaatactaatacactacgtgccagatactggggtggtgggctgggaccaaggaatgaagtaatgcatgtgccagagggttgaactttttaaaaggagtaaaaaagtaaatctttacagtagcagctggtgggtaggaggtattgagtccatagaactgctcttagattggaagggcatgggaaaatgaagttccattatgtgatagggttttacacacacacacacacacacacacacacaaatgtgagaaagtcactcaactataagcattcaaaaaagacagacatctttcttgtctttgtgggtcctgtacttagctcagctcatagaagccacaggaggaacctaataaatgttagttgatcatttactgatttaccaataaccaattcatgcctgctctagtgctgtggtctgaatgtgtcccccaaaattcatgttgaaagcctaacctccaaggtgatagtattaagaggtggggcctttgggaagctttgccatcattaatggaattaatgcctctataaaagaggccctatagagccccgtctactcttctactacatgaggtaatggtgaaaagacagctagctatctatgaacaagggaagagggccctcactaagatgtcaaatttgttggtaccttgatcttggacttctcagcccccagaaccgtgagaaataaacttctgttgtttataagccatgctgtctgtggtgttttgtaatagcagccagaacagactaagacatctagtaacacattctctggtaaacactaggaattcctggccttaaaaagttcatagctaatgagaaaagaaataaacaacataaaggataacatgctgtagtccactacatacaaggtgcttccagaccattcagaaaaactggataggaagatttctaaggtaatacttattgagtgcctacgtgttaggcgttttacatactttaagcctcacaactctggggaagtttcaccaacccattttacagatgacaaaactgtggcttaccaagattaataaggccagaattaaaattagggtctaattccaaagatattaccactatacataccaagatgtcttgttactacattttatccttacatttggcagtgaggggaaaactcaaaaagcagtcaaaaaacttttgtcctgaaccaacataaaaagagcacctaagacttcatccagtattttaccgaaagatcacttctaaaagtttgtcttcaccccgatctaaaaattagaaaactaattttctttcagcagctgcatatgtacataatgtaatgtttctacatttagacctacacaattataagtctaaacaaaatatgtgtaacatgattggagaacataactagcagtcatttaagaaaatggacatttggaaacatcatttcaagagcttgggatgaaaaattttgctatgacctataaatctggatcattccactgactgacactgagagaaacagtgtattatcacagtttacacagtaaatttttttggaggggagagggaggagattgaaatagaaatgatcgaaatagaaattatctaaagtttaagaaatacaactgattaaatgttacatgtcaaagacactgtaggtacccaataaatcctgttaaatggactgcacaagtgggatgagaacacgttttccccacacctctgactagtatgtacctttcttaggaagttattttttcagccatgggaaaaaaaagggcagaatttaggacagataaaacataagtagcttataaatcctctgaaaggaaatcaaaacacagtattttgtatctctgtataaagttaagctcctcagggacaggggcaatgtccagaggatagtgagcatactacttagcaaactaatgcaggttaataaatattgacacagtaagactagcatagtttacattctaattttgtaaagattataagttacctcttcatattctgttcttttatttctcctgtgtatattataaatacacaaagattgaaaattatttcttgaagctatttccttttttattttttggtcaactgtattagtgtttcttaaaagggcttctggtcatccttagggcttatcagtagcatcattaataatgtattcatttcactaaaaatgtggtaagtagcttggatttaaaaacaggatctaatttcaaagctatttccactatacacaccaagttacaactttcttatctctcctaaattctaaattttacatgatttaccaaatcacttcttaagtaagagtacttattgatcagaagtgtgagacaaacaccttatcccacttgtccaatttattcaacaagattgattgggtacctttgtgtctctgacaggtaactttcaacagttgtatttcttaaactttaggtcgtctcccaaaaaaaactgtaataatttgctgcttctctcaatattgcaggcagtaaaatgatccaaaattacgggtcatatccacatttcttcatgattgaggttaactgtgcactgtaaaccccatatgctattagtttacattttcaacagcaccctcgccacttaataatctcaaacagattttggactgttactaatttagcatatccataaaaagtcatttaaaaaatgtagacgctaaattctctttcaaggttgccaagcttcaccagtgtctgtattaaaattatttctaaaattttacggactaaggcatttggtacattcaattctacctttaccaacaaaagcctttaccaccaagatgaggaaagcatccttttcattttctacactgaaaaggggggggaaaaaaggccaactgcttgcatacaggtctgcatataacacagcagtctctggcaaagccaataactcacgttcaacttcagaaatcctggtggccggtaacacagagtaacctgtgcgcacaacccttgggcttgacataccacttcatccgccctcccttcccatcaatccacccccaaaaccccaacccaccaagcacacggctaaatatgtcttccccaagagagccaaaaaccttgaaaacgccgagaaagggctcccctttgaaggaaagggcctgcccttccctgtctggggccccggctggctcgaagagcctggctcctaggaggcccaaatctcgacgcctcgcacgtcccgccccgccccgggcccgctcgcgtcccctcgggcgacaaaaccctcccgccgtcgctcagccaggactgacagttacggctgcagcagccgcggccaccaggggcctacttctggcaccagccccttcggaccacgcgcccccaaacactcgcctcggcggcggggggcggggaaggggggtgtcgacctcgccacagcgggccccgaaggccggccgagtgacggaggggagccagcgccgcctggcgcaggccgcggcaacactgacctgtcgtcgcccccgcgcctgggctgcggcggccgcctcactggtcgtagtcgccctcgcccgccgcctccgcccgccaccgcctcgttctctttcgctgccgccaccgccggggctcatgcgggacccgcgcttccttatccggaaaacgaggccgggaaagggagcgccggggccgccgaaatcccggcgttcgtcgccagccgccgctgcctgtccacaccggggggctgaggggccctcctgccaggggctacaggccgcgagctattccgaggaggagccgaaggaggcgccgccgcccgcagccgagcgcgccgggtcggcagaggtgaagcgtaagtaggcggcggatggcgggcgcccgcgctggcggatggctacgcggcggaggggtgcgcgagcgagcgaagcctggtgtgtcgggtcctggcgaagggaaaaggccccgtcgtctcctgtagtcaccccgagcccagcgccaccatcttgggagacacacggatctcgcggccgcggcgcaagacgggaggactggctgggcgggccgagtatcccggcaggcagcgcgcgccgcccggccgggcgagggctccaggccgggacgcggggacgtggggcggggccaagacgcgcgggagggcgccgcgctccgcccctccttccttcgccggccccgcctccctcccgcttgccgtcgccgccggcgcacgggccattgggaagaggaggtggcctgcggcccctcggagtcccaccaggctcggtcgccatcttgcgactggacagaaagggtaatccctctttttagtttctgctgtctgtgacccgaaagaataaacctgggacttccggaagccctctgggcacccccccccccaggagggttgcagagccccttggtgtacccagcagaggaacgcctcagactttgttgggaaacgaatggctctgaaagttagctgaagccgctggaatagccccccagccccgaggcggggcaggtgcctgccgttattggcttttcgaccccaacccttttctatctggagctgcctttgtagatgttgcaggggtgccccgagagtgcaggccagattttagaggaccaaggtcatctacttaggcctcttgccaacacaggatgtgtcaactagtttaccagagacgaaggtaaagtcccgtctcctgcagttgttgacgttcagtaggtcgtcggttaagaaaagtggctccctggttgaccccagctggatagaggctaattttgatccatatgacagctgaacgtagttaaagccattaaaattaaatccatttaaagtcatatttggtaccagggtcaccattttaaaaggtgtgtgtgtgtatgtgtgtgtgtgtgtgtgtgtgtgtgtatagctttacaacacttgctagcaaagccaaaagagtatcactaacaattcatagtgttacaacttgcaactttgttgataagcccttgaagtactagatgagtacccatgtctagtattcagattttttatatcaacagtcgtacatagcagtgtatcttttttaaatttatttttatttttaaacttagaaatggtgtcttgctatgttaggcccaggctggtctcgagctcctggcctcaagtgatcctcccacctcggcctcccaaagttttgggactacaggcatgagccacagtgctcggccagcagtgtaatttttaactgtcagtctcggaacatcttttttgtatagccaagtgtgtgggtgtgtgtgtgtatccgcctcacaactataaccaaccattgaaaaaccaacaataagctagaagaatttaagttattccaggacaactgatgataatgatagtattaagccatattcgattttaagatgttttaactcagctctttactcacttttcatttcctctcattacacatccacatttggaaactatttgctgttatatttcatggaaaggactagtaagaattataatctttaaaaaaatttatcttcgcaagttttcaaaataggcaacaaagaatgtaaatctttaaggactttattgttggactaattaaagcataccatttctactatatctagcatatggagatacttataggtattcttccttttaagtagaaattgacaataaattaagtgtaattttataatggcctggtgtatcaaagtgtggcggaaatccctgagttccaaaaagattaaagaccgaagggaaataagtctgcttttagctagatgtcagaatgactattcattgctttactgagatcaaggaggatcttaattcctcctggagaaattacgtatatccgttttagttcattaattttaaatctgtattcttatgtgtgacattagtattagaattctttcaagatttcactgtgctttttgttttatccattttcaaatttagaaatgtttgctcatcaaacttaccaacataaatactttcaggaatccttaagatactagcagtgttccacttccctatacacctgtttatatg

SEQ ID NO: 2 - DNA, 20 bp, Artificial sequence
  Primer
ctcccccagttctggaatga

SEQ ID NO: 3 - DNA, 23 bp, Artificial sequence
  Primer
tacacagggatttgagcctgcta

SEQ ID NO: 4 - DNA, 26 bp, Artificial sequence
  Probe
cccacagatcaagcattccccaaaga

SEQ ID NO: 5 - DNA, 20 bp, Artificial sequence
  Primer
gcccgaagtgcctattcctt

SEQ ID NO: 6 - DNA, 24 bp, Artificial sequence
  Primer
tggtcaggagaacataggcataaa

SEQ ID NO: 7 - DNA, 26 bp, Artificial sequence
  Probe
actcccagggttgatgggctacatcc

SEQ ID NO: 8 - DNA, 20 bp, Artificial sequence
  Primer
caccctgatgtcaccgaatg

SEQ ID NO: 9 - DNA, 23 bp, Artificial sequence
  Primer
gcgttctattagatgctttgcag

SEQ ID NO: 10 - DNA, 30 bp, Artificial sequence
  Probe
actgaggttctcctgatcttttacaagctg

SEQ ID NO: 11 - DNA, 20 bp, Artificial sequence
  Primer
ggcaaattcaacggcacagt

SEQ ID NO: 12 - DNA, 20 bp, Artificial sequence
  Primer
gggtctcgctcctggaagat

SEQ ID NO: 13 - DNA, 27 bp, Artificial sequence
  Probe
aaggccgagaatgggaagcttgtcatc

SEQ ID NO: 14 - DNA, 22 bp, Artificial sequence
  Primer
tccttccctaccttagtcttga

SEQ ID NO: 15 - DNA, 20 bp, Artificial sequence
  Primer
ccctcttgaaccaggaaaca

SEQ ID NO: 16 - DNA, 25 bp, Artificial sequence
  Probe
agatggcagcccacatttctactgt

SEQ ID NO: 17 - DNA, 20 bp, Artificial sequence
  Synthetic oligonucleotide
atgttgcttgcactccatca

SEQ ID NO: 18 - DNA, 20 bp, Artificial sequence
  Synthetic oligonucleotide
acaacataaggtcttattgt

SEQ ID NO: 19 - DNA, 20 bp, Artificial sequence
  Synthetic oligonucleotide
ttttcaactccagaattttc

SEQ ID NO: 20 - DNA, 20 bp, Artificial sequence
  Synthetic oligonucleotide
ttcagtcttatacagaaatg

SEQ ID NO: 21 - DNA, 20 bp, Artificial sequence
  Synthetic oligonucleotide
ggactgacacagaaaactgg

SEQ ID NO: 22 - DNA, 20 bp, Artificial sequence
  Synthetic oligonucleotide
agggtagaagactagcatac

SEQ ID NO: 23 - DNA, 20 bp, Artificial sequence
  Synthetic oligonucleotide
ggccattcattcagccacac

SEQ ID NO: 24 - DNA, 20 bp, Artificial sequence
  Synthetic oligonucleotide
taaagattttatgaaaatac

SEQ ID NO: 25 - DNA, 20 bp, Artificial sequence
  Synthetic oligonucleotide
tttagaacatgtgaatttca

SEQ ID NO: 26 - DNA, 20 bp, Artificial sequence
  Synthetic oligonucleotide
agacatatcacagttgcttg

SEQ ID NO: 27 - DNA, 20 bp, Artificial sequence
  Synthetic oligonucleotide
aatataatgtagtatgacca

SEQ ID NO: 28 - DNA, 20 bp, Artificial sequence
  Synthetic oligonucleotide
gaggacactggcacatctat

SEQ ID NO: 29 - DNA, 20 bp, Artificial sequence
  Synthetic oligonucleotide
ttaaataataaaatatattt

SEQ ID NO: 30 - DNA, 20 bp, Artificial sequence
  Synthetic oligonucleotide
attggagcaaaaagggatca

SEQ ID NO: 31 - DNA, 20 bp, Artificial sequence
  Synthetic oligonucleotide
aattattccctatatcctgt

SEQ ID NO: 32 - DNA, 20 bp, Artificial sequence
  Synthetic oligonucleotide
caactgttaccaagacttca

SEQ ID NO: 33 - DNA, 20 bp, Artificial sequence
  Synthetic oligonucleotide
atctgcgaatagaggccctc

SEQ ID NO: 34 - DNA, 20 bp, Artificial sequence
  Synthetic oligonucleotide
aaggtttttatttcatcact

SEQ ID NO: 35 - DNA, 20 bp, Artificial sequence
  Synthetic oligonucleotide
gcccatggatggttgtcaaa

SEQ ID NO: 36 - DNA, 20 bp, Artificial sequence
  Synthetic oligonucleotide
taggttgcataaagccaggc

SEQ ID NO: 37 - DNA, 20 bp, Artificial sequence
  Synthetic oligonucleotide
cacacatcttgttccctcaa

SEQ ID NO: 38 - DNA, 20 bp, Artificial sequence
  Synthetic oligonucleotide
tttttttaatcctctgatga

SEQ ID NO: 39 - DNA, 20 bp, Artificial sequence
  Synthetic oligonucleotide
agtctcttttctttcggtgc

SEQ ID NO: 40 - DNA, 20 bp, Artificial sequence
  Synthetic oligonucleotide
ggaaagttcttctctctcct

SEQ ID NO: 41 - DNA, 20 bp, Artificial sequence
  Synthetic oligonucleotide
atttggtctaaagtgaagtt

SEQ ID NO: 42 - DNA, 20 bp, Artificial sequence
  Synthetic oligonucleotide
ttttgtgagatttttgaata

SEQ ID NO: 43 - DNA, 20 bp, Artificial sequence
  Synthetic oligonucleotide
tgttaaatgcttttctaaat

SEQ ID NO: 44 - DNA, 20 bp, Artificial sequence
  Synthetic oligonucleotide
ctgatgattgattgtttcct

SEQ ID NO: 45 - DNA, 20 bp, Artificial sequence
  Synthetic oligonucleotide
tatgataatgtgtagttttt

SEQ ID NO: 46 - DNA, 20 bp, Artificial sequence
  Synthetic oligonucleotide
aagggtaatacggacctcat

SEQ ID NO: 47 - DNA, 20 bp, Artificial sequence
  Synthetic oligonucleotide
ctattttttgcttcccttat

SEQ ID NO: 48 - DNA, 20 bp, Artificial sequence
  Synthetic oligonucleotide
gaattcttagaaagttaatt

SEQ ID NO: 49 - DNA, 20 bp, Artificial sequence
  Synthetic oligonucleotide
tgccatcttcaagactaagg

SEQ ID NO: 50 - DNA, 20 bp, Artificial sequence
  Synthetic oligonucleotide
aatggaaaagatgtatcacg

SEQ ID NO: 51 - DNA, 20 bp, Artificial sequence
  Synthetic oligonucleotide
aactttggcagctattcaat

SEQ ID NO: 52 - DNA, 20 bp, Artificial sequence
  Synthetic oligonucleotide
gacactaggttttgcaaaag

SEQ ID NO: 53 - DNA, 20 bp, Artificial sequence
  Synthetic oligonucleotide
tatgaattttcaattcaatg

SEQ ID NO: 54 - DNA, 20 bp, Artificial sequence
  Synthetic oligonucleotide
cacttaagggaactttcaga

SEQ ID NO: 55 - DNA, 20 bp, Artificial sequence
  Synthetic oligonucleotide
gagatgatgttaagctttca

SEQ ID NO: 56 - DNA, 20 bp, Artificial sequence
  Synthetic oligonucleotide
taagacaagtggccatgaag

SEQ ID NO: 57 - DNA, 20 bp, Artificial sequence
  Synthetic oligonucleotide
ctctgttctgtctcaaaaca

SEQ ID NO: 58 - DNA, 20 bp, Artificial sequence
  Synthetic oligonucleotide
tataagaaagaagattacag

SEQ ID NO: 59 - DNA, 20 bp, Artificial sequence
  Synthetic oligonucleotide
aaatgttaatagactgcgat

SEQ ID NO: 60 - DNA, 20 bp, Artificial sequence
  Synthetic oligonucleotide
ttaaactccccagtcaaaag

SEQ ID NO: 61 - DNA, 20 bp, Artificial sequence
  Synthetic oligonucleotide
atttacttcaaacaggagct

SEQ ID NO: 62 - DNA, 20 bp, Artificial sequence
  Synthetic oligonucleotide
tcaggaaattaaagcattca

SEQ ID NO: 63 - DNA, 20 bp, Artificial sequence
  Synthetic oligonucleotide
cctaacctggatctcagata

SEQ ID NO: 64 - DNA, 20 bp, Artificial sequence
  Synthetic oligonucleotide
tacagcaaccctagaaaact

SEQ ID NO: 65 - DNA, 20 bp, Artificial sequence
  Synthetic oligonucleotide
atctttggcagatgtaacct

SEQ ID NO: 66 - DNA, 20 bp, Artificial sequence
  Synthetic oligonucleotide
gagtattatccaaaagaaca

SEQ ID NO: 67 - DNA, 20 bp, Artificial sequence
  Synthetic oligonucleotide
aaagcccaggattaggcagc

SEQ ID NO: 68 - DNA, 20 bp, Artificial sequence
  Synthetic oligonucleotide
ctacaaagagtgaatcatga

SEQ ID NO: 69 - DNA, 20 bp, Artificial sequence
  Synthetic oligonucleotide
taatcttaagtttaagtgga

SEQ ID NO: 70 - DNA, 20 bp, Artificial sequence
  Synthetic oligonucleotide
aaaaagacatagaatgacag

SEQ ID NO: 71 - DNA, 20 bp, Artificial sequence
  Synthetic oligonucleotide
agatacaaatttaaaaaagt

SEQ ID NO: 72 - DNA, 20 bp, Artificial sequence
  Synthetic oligonucleotide
ggtagccccaatacagattc

SEQ ID NO: 73 - DNA, 20 bp, Artificial sequence
  Synthetic oligonucleotide
cttcaacagcagacttgatc

SEQ ID NO: 74 - DNA, 20 bp, Artificial sequence
  Synthetic oligonucleotide
ggtccacacagagttcaaat

SEQ ID NO: 75 - DNA, 20 bp, Artificial sequence
  Synthetic oligonucleotide
ctttgggacatcccaaagtt

SEQ ID NO: 76 - DNA, 20 bp, Artificial sequence
  Synthetic oligonucleotide
tacacatcttgtatacaagg

SEQ ID NO: 77 - DNA, 20 bp, Artificial sequence
  Synthetic oligonucleotide
taatactttcttgagtaata

SEQ ID NO: 78 - DNA, 20 bp, Artificial sequence
  Synthetic oligonucleotide
gggtggttggattgctttat

SEQ ID NO: 79 - DNA, 20 bp, Artificial sequence
  Synthetic oligonucleotide
ctgcacactgtacaggaggg

SEQ ID NO: 80 - DNA, 20 bp, Artificial sequence
  Synthetic oligonucleotide
ttgattcactgcacactgta

SEQ ID NO: 81 - DNA, 20 bp, Artificial sequence
  Synthetic oligonucleotide
gtgcaggaaggaggttttgt

SEQ ID NO: 82 - DNA, 20 bp, Artificial sequence
  Synthetic oligonucleotide
atacagtatatacatcatcc

SEQ ID NO: 83 - DNA, 20 bp, Artificial sequence
  Synthetic oligonucleotide
aagtttaaaacaaaaaaagg

SEQ ID NO: 84 - DNA, 20 bp, Artificial sequence
  Synthetic oligonucleotide
aatgtctgttctttgtggta

SEQ ID NO: 85 - DNA, 20 bp, Artificial sequence
  Synthetic oligonucleotide
atacctgcttttgtgacaat

SEQ ID NO: 86 - DNA, 20 bp, Artificial sequence
  Synthetic oligonucleotide
gagtgtagctcatttcagaa

SEQ ID NO: 87 - DNA, 20 bp, Artificial sequence
  Synthetic oligonucleotide
tttctcaatgtcaactctca

SEQ ID NO: 88 - DNA, 20 bp, Artificial sequence
  Synthetic oligonucleotide
caagccgaatcttgacatac

SEQ ID NO: 89 - DNA, 20 bp, Artificial sequence
  Synthetic oligonucleotide
gaccagaaaagctacatagc

SEQ ID NO: 90 - DNA, 20 bp, Artificial sequence
  Synthetic oligonucleotide
attttgtatattgtagcttt

SEQ ID NO: 91 - DNA, 20 bp, Artificial sequence
  Synthetic oligonucleotide
ccatctttctgttatcttgt

SEQ ID NO: 92 - DNA, 20 bp, Artificial sequence
  Synthetic oligonucleotide
ctttgtttctttttaagaaa

SEQ ID NO: 93 - DNA, 20 bp, Artificial sequence
  Synthetic oligonucleotide
accttgacaacaccctagct

SEQ ID NO: 94 - DNA, 20 bp, Artificial sequence
  Synthetic oligonucleotide
aaaaaggaaccataaactaa

SEQ ID NO: 95 - DNA, 20 bp, Artificial sequence
  Synthetic oligonucleotide
ggtgtgtcagctgtgctggt

SEQ ID NO: 96 - DNA, 20 bp, Artificial sequence
  Synthetic oligonucleotide
atcataccttcacttttttt

SEQ ID NO: 97 - DNA, 20 bp, Artificial sequence
  Synthetic oligonucleotide
ttcattgagcttcctggata

SEQ ID NO: 98 - DNA, 20 bp, Artificial sequence
  Synthetic oligonucleotide
ttacttctttttcattaagt

SEQ ID NO: 99 - DNA, 20 bp, Artificial sequence
  Synthetic oligonucleotide
agtaaacactccaacaaaaa

SEQ ID NO: 100 - DNA, 20 bp, Artificial sequence
  Synthetic oligonucleotide
ggtctaagcaaaatgtgaag

SEQ ID NO: 101 - DNA, 20 bp, Artificial sequence
  Synthetic oligonucleotide
cagttaggcctgctccgaat

SEQ ID NO: 102 - DNA, 20 bp, Artificial sequence
  Synthetic oligonucleotide
actctgaaaatagccaattt

SEQ ID NO: 103 - DNA, 20 bp, Artificial sequence
  Synthetic oligonucleotide
agtatctatctacaattaaa

SEQ ID NO: 104 - DNA, 20 bp, Artificial sequence
  Synthetic oligonucleotide
aatggcttagctactcaccc

SEQ ID NO: 105 - DNA, 20 bp, Artificial sequence
  Synthetic oligonucleotide
cctctctgcaaaacaagaga

SEQ ID NO: 106 - DNA, 20 bp, Artificial sequence
  Synthetic oligonucleotide
attactcattctgggaatgc

SEQ ID NO: 107 - DNA, 20 bp, Artificial sequence
  Synthetic oligonucleotide
gttttcagcatgattctaac

SEQ ID NO: 108 - DNA, 20 bp, Artificial sequence
  Synthetic oligonucleotide
catatataaaaattagaatg

SEQ ID NO: 109 - DNA, 20 bp, Artificial sequence
  Synthetic oligonucleotide
aatgccacaaagctggctgt

SEQ ID NO: 110 - DNA, 20 bp, Artificial sequence
  Synthetic oligonucleotide
gtgcacagataatgactaga

SEQ ID NO: 111 - DNA, 20 bp, Artificial sequence
  Synthetic oligonucleotide
cagtgagaagtcaattgtca

SEQ ID NO: 112 - DNA, 20 bp, Artificial sequence
  Synthetic oligonucleotide
tcctttagcatttctattag

SEQ ID NO: 113 - DNA, 20 bp, Artificial sequence
  Synthetic oligonucleotide
aacatgtgcttgcaagccat

SEQ ID NO: 114 - DNA, 20 bp, Artificial sequence
  Synthetic oligonucleotide
aaataactggatctcataac

SEQ ID NO: 115 - DNA, 20 bp, Artificial sequence
  Synthetic oligonucleotide
cttaggagagaaacactttc

SEQ ID NO: 116 - DNA, 20 bp, Artificial sequence
  Synthetic oligonucleotide
tacatcctgtaggctttctt

SEQ ID NO: 117 - DNA, 20 bp, Artificial sequence
  Synthetic oligonucleotide
actgagaaatctcttgaatg

SEQ ID NO: 118 - DNA, 20 bp, Artificial sequence
  Synthetic oligonucleotide
ttgctctttttactttgttc

SEQ ID NO: 119 - DNA, 20 bp, Artificial sequence
  Synthetic oligonucleotide
actctaagttttattaatag

SEQ ID NO: 120 - DNA, 20 bp, Artificial sequence
  Synthetic oligonucleotide
tttggaagagcttaataaag

SEQ ID NO: 121 - DNA, 20 bp, Artificial sequence
  Synthetic oligonucleotide
tagctagaatttcaactact

SEQ ID NO: 122 - DNA, 20 bp, Artificial sequence
  Synthetic oligonucleotide
atgtagtatttatttcattt

SEQ ID NO: 123 - DNA, 20 bp, Artificial sequence
  Synthetic oligonucleotide
gcctaatatgtgtcatcctg

SEQ ID NO: 124 - DNA, 20 bp, Artificial sequence
  Synthetic oligonucleotide
cctcaattctatggttagtt

SEQ ID NO: 125 - DNA, 20 bp, Artificial sequence
  Synthetic oligonucleotide
tcttggagatgacttctctg

SEQ ID NO: 126 - DNA, 20 bp, Artificial sequence
  Synthetic oligonucleotide
tcttcaagactaaggtaggg

SEQ ID NO: 127 - DNA, 20 bp, Artificial sequence
  Synthetic oligonucleotide
agtaaggtctgttattctcc

SEQ ID NO: 128 - DNA, 20 bp, Artificial sequence
  Synthetic oligonucleotide
gctatacaacaaaaagaatt

SEQ ID NO: 129 - DNA, 20 bp, Artificial sequence
  Synthetic oligonucleotide
actgtggaaaaactttggca

SEQ ID NO: 130 - DNA, 20 bp, Artificial sequence
  Synthetic oligonucleotide
ataatctacatgtatagacc

SEQ ID NO: 131 - DNA, 20 bp, Artificial sequence
  Synthetic oligonucleotide
aaaagccaattctgaaattc

SEQ ID NO: 132 - DNA, 20 bp, Artificial sequence
  Synthetic oligonucleotide
attctcctacctctcagcct

SEQ ID NO: 133 - DNA, 20 bp, Artificial sequence
  Synthetic oligonucleotide
aactgtagcaaatatactac

SEQ ID NO: 134 - DNA, 20 bp, Artificial sequence
  Synthetic oligonucleotide
aaattactgctctgtaaaag

SEQ ID NO: 135 - DNA, 20 bp, Artificial sequence
  Synthetic oligonucleotide
gattcaatgaaataaaaaat

SEQ ID NO: 136 - DNA, 20 bp, Artificial sequence
  Synthetic oligonucleotide
aatgacatagcttatgctgt

SEQ ID NO: 137 - DNA, 20 bp, Artificial sequence
  Synthetic oligonucleotide
ctagaaattaagacatccct

SEQ ID NO: 138 - DNA, 20 bp, Artificial sequence
  Synthetic oligonucleotide
gccacaccatcaaaagaacc

SEQ ID NO: 139 - DNA, 20 bp, Artificial sequence
  Synthetic oligonucleotide
tggaccacctaagacctcaa

SEQ ID NO: 140 - DNA, 20 bp, Artificial sequence
  Synthetic oligonucleotide
accggttcccaattttctcc

SEQ ID NO: 141 - DNA, 20 bp, Artificial sequence
  Synthetic oligonucleotide
gagagaatacggccctgatg

SEQ ID NO: 142 - DNA, 20 bp, Artificial sequence
  Synthetic oligonucleotide
aacttcaatcagagtaatat

SEQ ID NO: 143 - DNA, 20 bp, Artificial sequence
  Synthetic oligonucleotide
ggcaaaggaatgaagagacc

SEQ ID NO: 144 - DNA, 20 bp, Artificial sequence
  Synthetic oligonucleotide
gccaataacaagaaaagaga

SEQ ID NO: 145 - DNA, 20 bp, Artificial sequence
  Synthetic oligonucleotide
atcaaattggatgacctaaa

SEQ ID NO: 146 - DNA, 20 bp, Artificial sequence
  Synthetic oligonucleotide
caatggatttcaattacact

SEQ ID NO: 147 - DNA, 20 bp, Artificial sequence
  Synthetic oligonucleotide
attctccaacaaaaagacat

SEQ ID NO: 148 - DNA, 20 bp, Artificial sequence
  Synthetic oligonucleotide
gtagctacaagaagtaattg

SEQ ID NO: 149 - DNA, 20 bp, Artificial sequence
  Synthetic oligonucleotide
aaagaatgcctataagaatt

SEQ ID NO: 150 - DNA, 20 bp, Artificial sequence
  Synthetic oligonucleotide
ctactggcatcagtcaaaac

SEQ ID NO: 151 - DNA, 20 bp, Artificial sequence
  Synthetic oligonucleotide
aaaaggcaaggctaaggagt

SEQ ID NO: 152 - DNA, 20 bp, Artificial sequence
  Synthetic oligonucleotide
cccacacaggtcattcattc

SEQ ID NO: 153 - DNA, 20 bp, Artificial sequence
  Synthetic oligonucleotide
tgtatacaccatcccagaaa

SEQ ID NO: 154 - DNA, 20 bp, Artificial sequence
  Synthetic oligonucleotide
aaaatgccagtttgttgtac

SEQ ID NO: 155 - DNA, 20 bp, Artificial sequence
  Synthetic oligonucleotide
acactgtacaggagggtgtc

SEQ ID NO: 156 - DNA, 20 bp, Artificial sequence
  Synthetic oligonucleotide
ttcactgcacactgtacagg

SEQ ID NO: 157 - DNA, 20 bp, Artificial sequence
  Synthetic oligonucleotide
aaatgatgttgattcactgc

SEQ ID NO: 158 - DNA, 20 bp, Artificial sequence
  Synthetic oligonucleotide
agagttttcatgaattcagg

SEQ ID NO: 159 - DNA, 20 bp, Artificial sequence
  Synthetic oligonucleotide
ggtttctttcattaaatagc

SEQ ID NO: 160 - DNA, 20 bp, Artificial sequence
  Synthetic oligonucleotide
gaggcaactcctgagagctg

SEQ ID NO: 161 - DNA, 20 bp, Artificial sequence
  Synthetic oligonucleotide
ttaaatgtcaggaggtcccc

SEQ ID NO: 162 - DNA, 20 bp, Artificial sequence
  Synthetic oligonucleotide
tgtcatctgatctcacacat

SEQ ID NO: 163 - DNA, 20 bp, Artificial sequence
  Synthetic oligonucleotide
caaagtccaagggaaatgat

SEQ ID NO: 164 - DNA, 20 bp, Artificial sequence
  Synthetic oligonucleotide
cacagtagaggcaaatgaga

SEQ ID NO: 165 - DNA, 20 bp, Artificial sequence
  Synthetic oligonucleotide
gacatttaggatgatgatat

SEQ ID NO: 166 - DNA, 20 bp, Artificial sequence
  Synthetic oligonucleotide
gttgtattaatggacttttg

SEQ ID NO: 167 - DNA, 20 bp, Artificial sequence
  Synthetic oligonucleotide
attttttgcataagtgcatt

SEQ ID NO: 168 - DNA, 20 bp, Artificial sequence
  Synthetic oligonucleotide
acatttcttagttgaacagt

SEQ ID NO: 169 - DNA, 20 bp, Artificial sequence
  Synthetic oligonucleotide
agattcttccccaatcccat

SEQ ID NO: 170 - DNA, 20 bp, Artificial sequence
  Synthetic oligonucleotide
ctcacttgtctccttttacc

SEQ ID NO: 171 - DNA, 20 bp, Artificial sequence
  Synthetic oligonucleotide
acaataaggaagagcaaaac

SEQ ID NO: 172 - DNA, 20 bp, Artificial sequence
  Synthetic oligonucleotide
atcatgtgcatacccagggt

SEQ ID NO: 173 - DNA, 20 bp, Artificial sequence
  Synthetic oligonucleotide
tcactcattttgttcagctt

SEQ ID NO: 174 - DNA, 20 bp, Artificial sequence
  Synthetic oligonucleotide
gttttcactcattttgttca

SEQ ID NO: 175 - DNA, 20 bp, Artificial sequence
  Synthetic oligonucleotide
acaattattctcatcatcga

SEQ ID NO: 176 - DNA, 20 bp, Artificial sequence
  Synthetic oligonucleotide
cctcagcatcctcagacaat

SEQ ID NO: 177 - DNA, 20 bp, Artificial sequence
  Synthetic oligonucleotide
tctggaatgagtccctcagc

SEQ ID NO: 178 - DNA, 20 bp, Artificial sequence
  Synthetic oligonucleotide
ctcagattgacatctggaat

SEQ ID NO: 179 - DNA, 20 bp, Artificial sequence
  Synthetic oligonucleotide
cactcattttgttcagcttt

SEQ ID NO: 180 - DNA, 20 bp, Artificial sequence
  Synthetic oligonucleotide
agttttcactcattttgttc

SEQ ID NO: 181 - DNA, 20 bp, Artificial sequence
  Synthetic oligonucleotide
gtcatcacctctcttcagga

SEQ ID NO: 182 - DNA, 20 bp, Artificial sequence
  Synthetic oligonucleotide
aagtcatcacctctcttcag

SEQ ID NO: 183 - DNA, 20 bp, Artificial sequence
  Synthetic oligonucleotide
ttaagtcatcacctctcttc

SEQ ID NO: 184 - DNA, 20 bp, Artificial sequence
  Synthetic oligonucleotide
ttttaagtcatcacctctct

SEQ ID NO: 185 - DNA, 20 bp, Artificial sequence
  Synthetic oligonucleotide
atttttaagtcatcacctct

SEQ ID NO: 186 - DNA, 20 bp, Artificial sequence
  Synthetic oligonucleotide
tgatttttaagtcatcacct

SEQ ID NO: 187 - DNA, 20 bp, Artificial sequence
  Synthetic oligonucleotide
catgatttttaagtcatcac

SEQ ID NO: 188 - DNA, 20 bp, Artificial sequence
  Synthetic oligonucleotide
agcatgatttttaagtcatc

SEQ ID NO: 189 - DNA, 20 bp, Artificial sequence
  Synthetic oligonucleotide
tgagcatgatttttaagtca

SEQ ID NO: 190 - DNA, 20 bp, Artificial sequence
  Synthetic oligonucleotide
attgagcatgatttttaagt

SEQ ID NO: 191 - DNA, 20 bp, Artificial sequence
  Synthetic oligonucleotide
ctattgagcatgatttttaa

SEQ ID NO: 192 - DNA, 20 bp, Artificial sequence
  Synthetic oligonucleotide
tcctattgagcatgattttt

SEQ ID NO: 193 - DNA, 20 bp, Artificial sequence
  Synthetic oligonucleotide
aatcctattgagcatgattt

SEQ ID NO: 194 - DNA, 20 bp, Artificial sequence
  Synthetic oligonucleotide
gtaatcctattgagcatgat

SEQ ID NO: 195 - DNA, 20 bp, Artificial sequence
  Synthetic oligonucleotide
gcgtaatcctattgagcatg

SEQ ID NO: 196 - DNA, 20 bp, Artificial sequence
  Synthetic oligonucleotide
cagcgtaatcctattgagca

SEQ ID NO: 197 - DNA, 20 bp, Artificial sequence
  Synthetic oligonucleotide
ctcagcgtaatcctattgag

SEQ ID NO: 198 - DNA, 20 bp, Artificial sequence
  Synthetic oligonucleotide
gcctcagcgtaatcctattg

SEQ ID NO: 199 - DNA, 20 bp, Artificial sequence
  Synthetic oligonucleotide
gggcctcagcgtaatcctat

SEQ ID NO: 200 - DNA, 20 bp, Artificial sequence
  Synthetic oligonucleotide
ctgggcctcagcgtaatcct

SEQ ID NO: 201 - DNA, 20 bp, Artificial sequence
  Synthetic oligonucleotide
ggctgggcctcagcgtaatc

SEQ ID NO: 202 - DNA, 20 bp, Artificial sequence
  Synthetic oligonucleotide
taggctgggcctcagcgtaa

SEQ ID NO: 203 - DNA, 20 bp, Artificial sequence
  Synthetic oligonucleotide
cctaggctgggcctcagcgt

SEQ ID NO: 204 - DNA, 20 bp, Artificial sequence
  Synthetic oligonucleotide
cacctaggctgggcctcagc

SEQ ID NO: 205 - DNA, 20 bp, Artificial sequence
  Synthetic oligonucleotide
ctcacctaggctgggcctca

SEQ ID NO: 206 - DNA, 20 bp, Artificial sequence
  Synthetic oligonucleotide
ttctcacctaggctgggcct

SEQ ID NO: 207 - DNA, 20 bp, Artificial sequence
  Synthetic oligonucleotide
aattctcacctaggctgggc

SEQ ID NO: 208 - DNA, 20 bp, Artificial sequence
  Synthetic oligonucleotide
aaaattctcacctaggctgg

SEQ ID NO: 209 - DNA, 20 bp, Artificial sequence
  Synthetic oligonucleotide
ccaaaattctcacctaggct

SEQ ID NO: 210 - DNA, 20 bp, Artificial sequence
  Synthetic oligonucleotide
cttccaaaattctcacctag

SEQ ID NO: 211 - DNA, 20 bp, Artificial sequence
  Synthetic oligonucleotide
cctcttccaaaattctcacc

SEQ ID NO: 212 - DNA, 20 bp, Artificial sequence
  Synthetic oligonucleotide
catcctcttccaaaattctc

SEQ ID NO: 213 - DNA, 20 bp, Artificial sequence
  Synthetic oligonucleotide
cagcatcctcttccaaaatt

SEQ ID NO: 214 - DNA, 20 bp, Artificial sequence
  Synthetic oligonucleotide
tcccagcatcctcttccaaa

SEQ ID NO: 215 - DNA, 20 bp, Artificial sequence
  Synthetic oligonucleotide
ggatcccagcatcctcttcc

SEQ ID NO: 216 - DNA, 20 bp, Artificial sequence
  Synthetic oligonucleotide
gccacccacatgccctgccc

SEQ ID NO: 217 - DNA, 20 bp, Artificial sequence
  Synthetic oligonucleotide
agagctcactgaaagacaca

SEQ ID NO: 218 - DNA, 20 bp, Artificial sequence
  Synthetic oligonucleotide
gaagagctcactgaaagaca

SEQ ID NO: 219 - DNA, 20 bp, Artificial sequence
  Synthetic oligonucleotide
gcaggatccactcacctatg

SEQ ID NO: 220 - DNA, 20 bp, Artificial sequence
  Synthetic oligonucleotide
cagagctcagccttgaccca

SEQ ID NO: 221 - DNA, 20 bp, Artificial sequence
  Synthetic oligonucleotide
agctcagtgcaggagaccag

SEQ ID NO: 222 - DNA, 20 bp, Artificial sequence
  Synthetic oligonucleotide
ccacagctcagtgcaggaga

SEQ ID NO: 223 - DNA, 20 bp, Artificial sequence
  Synthetic oligonucleotide
gatgtgctcaccacagctca

SEQ ID NO: 224 - DNA, 20 bp, Artificial sequence
  Synthetic oligonucleotide
ggaaccctttcctgcctgga

SEQ ID NO: 225 - DNA, 20 bp, Artificial sequence
  Synthetic oligonucleotide
caatataaggttctcatcat

SEQ ID NO: 226 - DNA, 20 bp, Artificial sequence
  Synthetic oligonucleotide
tcaggacaatataaggttct

SEQ ID NO: 227 - DNA, 20 bp, Artificial sequence
  Synthetic oligonucleotide
catcacctctcttcaggaca

SEQ ID NO: 228 - DNA, 20 bp, Artificial sequence
  Synthetic oligonucleotide
tctcacctaggctaggcctc

SEQ ID NO: 229 - DNA, 20 bp, Artificial sequence
  Synthetic oligonucleotide
agctcactgaaagacacaag

SEQ ID NO: 230 - DNA, 20 bp, Artificial sequence
  Synthetic oligonucleotide
aggaagggcctgagcttcag

SEQ ID NO: 231 - DNA, 20 bp, Artificial sequence
  Synthetic oligonucleotide
ctcaccacacctcagtgcag

SEQ ID NO: 232 - DNA, 20 bp, Artificial sequence
  Synthetic oligonucleotide
ctttcctgcctggaccacca

SEQ ID NO: 233 - DNA, 20 bp, Artificial sequence
  Synthetic oligonucleotide
ttgggcaccctccagatgcc

SEQ ID NO: 234 - DNA, 20 bp, Artificial sequence
  Synthetic oligonucleotide
cactcacctatgctggtcaa

SEQ ID NO: 235 - DNA, 20 bp, Artificial sequence
  Synthetic oligonucleotide
tcagctgggtgctgccctgc

SEQ ID NO: 236 - DNA, 20 bp, Artificial sequence
  Synthetic oligonucleotide
ccattcagggccatgggttt

SEQ ID NO: 237 - DNA, 20 bp, Artificial sequence
  Synthetic oligonucleotide
tccctgcacatgcatccagc

SEQ ID NO: 238 - DNA, 20 bp, Artificial sequence
  Synthetic oligonucleotide
actccagggaccaagagctc

SEQ ID NO: 239 - DNA, 20 bp, Artificial sequence
  Synthetic oligonucleotide
gagacccactgagatggccc

SEQ ID NO: 240 - DNA, 20 bp, Artificial sequence
  Synthetic oligonucleotide
accccatgaccctggaggtg

SEQ ID NO: 241 - DNA, 20 bp, Artificial sequence
  Synthetic oligonucleotide
atgaccccagcaggatgcac

SEQ ID NO: 242 - DNA, 20 bp, Artificial sequence
  Synthetic oligonucleotide
tcacccaccactgtccagag

SEQ ID NO: 243 - DNA, 20 bp, Artificial sequence
  Synthetic oligonucleotide
gtaccactgagatggcccat

SEQ ID NO: 244 - DNA, 20 bp, Artificial sequence
  Synthetic oligonucleotide
aatgcagacctggcagtcgc

SEQ ID NO: 245 - DNA, 20 bp, Artificial sequence
  Synthetic oligonucleotide
cttcaactaacagtatctta

SEQ ID NO: 246 - DNA, 20 bp, Artificial sequence
  Synthetic oligonucleotide
agtcttcaactaacagtatc

SEQ ID NO: 247 - DNA, 20 bp, Artificial sequence
  Synthetic oligonucleotide
ctatttcattaagtcacccc

SEQ ID NO: 248 - DNA, 20 bp, Artificial sequence
  Synthetic oligonucleotide
ggacagctgtgtggagggat

SEQ ID NO: 249 - DNA, 20 bp, Artificial sequence
  Synthetic oligonucleotide
accaccagggagaccagcct

SEQ ID NO: 250 - DNA, 20 bp, Artificial sequence
  Synthetic oligonucleotide
cagcctttctaccaccaggg

SEQ ID NO: 251 - DNA, 20 bp, Artificial sequence
  Synthetic oligonucleotide
tcagcctttctaccaccagg

SEQ ID NO: 252 - DNA, 20 bp, Artificial sequence
  Synthetic oligonucleotide
acagagtgtttactgtgagc

SEQ ID NO: 253 - DNA, 20 bp, Artificial sequence
  Synthetic oligonucleotide
tccatggaatggctgtcatg

SEQ ID NO: 254 - DNA, 20 bp, Artificial sequence
  Synthetic oligonucleotide
ttccttcagagttatttctt

SEQ ID NO: 255 - DNA, 20 bp, Artificial sequence
  Synthetic oligonucleotide
ttattctccttccttcagag

SEQ ID NO: 256 - DNA, 20 bp, Artificial sequence
  Synthetic oligonucleotide
gttattctccttccttcaga

SEQ ID NO: 257 - DNA, 20 bp, Artificial sequence
  Synthetic oligonucleotide
gaagtagtcctgccctttcc

SEQ ID NO: 258 - DNA, 20 bp, Artificial sequence
  Synthetic oligonucleotide
atatcctttcctctcctact

SEQ ID NO: 259 - DNA, 20 bp, Artificial sequence
  Synthetic oligonucleotide
gactgatggttacccataca

SEQ ID NO: 260 - DNA, 20 bp, Artificial sequence
  Synthetic oligonucleotide
catttaacaactattatctt

SEQ ID NO: 261 - DNA, 20 bp, Artificial sequence
  Synthetic oligonucleotide
tcattaaatagctaaccatt

SEQ ID NO: 262 - DNA, 20 bp, Artificial sequence
  Synthetic oligonucleotide
ccactttgcaactcaagatt

SEQ ID NO: 263 - DNA, 20 bp, Artificial sequence
  Synthetic oligonucleotide
cagccactttgcaactcaag

SEQ ID NO: 264 - DNA, 20 bp, Artificial sequence
  Synthetic oligonucleotide
gactccagccactttgcaac

SEQ ID NO: 265 - DNA, 20 bp, Artificial sequence
  Synthetic oligonucleotide
ccagaaatttagtctgttgt

SEQ ID NO: 266 - DNA, 20 bp, Artificial sequence
  Synthetic oligonucleotide
cataagctgctggatttgtt

SEQ ID NO: 267 - DNA, 20 bp, Artificial sequence
  Synthetic oligonucleotide
gaagagaacgaggatataaa

SEQ ID NO: 268 - DNA, 20 bp, Artificial sequence
  Synthetic oligonucleotide
gtgatatattagaactgtat

SEQ ID NO: 269 - DNA, 20 bp, Artificial sequence
  Synthetic oligonucleotide
agaggatttagagttaaaat

SEQ ID NO: 270 - DNA, 20 bp, Artificial sequence
  Synthetic oligonucleotide
actgaaaggtctgtatgttt

SEQ ID NO: 271 - DNA, 20 bp, Artificial sequence
  Synthetic oligonucleotide
caggcctagcttccacctaa

SEQ ID NO: 272 - DNA, 20 bp, Artificial sequence
  Synthetic oligonucleotide
tctgtcaaagacctgtgagg

SEQ ID NO: 273 - DNA, 20 bp, Artificial sequence
  Synthetic oligonucleotide
tctgcttgtggttcttccct

SEQ ID NO: 274 - DNA, 20 bp, Artificial sequence
  Synthetic oligonucleotide
caaatatggaatagcacttg

SEQ ID NO: 275 - DNA, 20 bp, Artificial sequence
  Synthetic oligonucleotide
gttgagaacggtattgagta

SEQ ID NO: 276 - DNA, 20 bp, Artificial sequence
  Synthetic oligonucleotide
ctcttgttttcagttgagaa

SEQ ID NO: 277 - DNA, 20 bp, Artificial sequence
  Synthetic oligonucleotide
atttctccatggactccaga

SEQ ID NO: 278 - DNA, 20 bp, Artificial sequence
  Synthetic oligonucleotide
cattggcttcatatttctcc

SEQ ID NO: 279 - DNA, 20 bp, Artificial sequence
  Synthetic oligonucleotide
tattgccttcactgctgcct

SEQ ID NO: 280 - DNA, 20 bp, Artificial sequence
  Synthetic oligonucleotide
actgacttgctctgcctact

SEQ ID NO: 281 - DNA, 20 bp, Artificial sequence
  Synthetic oligonucleotide
gagaagtctctcatggcacc

SEQ ID NO: 282 - DNA, 20 bp, Artificial sequence
  Synthetic oligonucleotide
ggagtgctccacacttctgt

SEQ ID NO: 283 - DNA, 20 bp, Artificial sequence
  Synthetic oligonucleotide
ctccaggttgtggaggttgt

SEQ ID NO: 284 - DNA, 20 bp, Artificial sequence
  Synthetic oligonucleotide
gtatatactccaggttgtgg

SEQ ID NO: 285 - DNA, 20 bp, Artificial sequence
  Synthetic oligonucleotide
acttctcattctctccacca

SEQ ID NO: 286 - DNA, 20 bp, Artificial sequence
  Synthetic oligonucleotide
aaagcattttctaccagagc

SEQ ID NO: 287 - DNA, 20 bp, Artificial sequence
  Synthetic oligonucleotide
tagacaaggaaagcattttc

SEQ ID NO: 288 - DNA, 20 bp, Artificial sequence
  Synthetic oligonucleotide
cacctgccctgcttttgctt

SEQ ID NO: 289 - DNA, 20 bp, Artificial sequence
  Synthetic oligonucleotide
tggtcctagcttcacctgcc

SEQ ID NO: 290 - DNA, 20 bp, Artificial sequence
  Synthetic oligonucleotide
agatccaacctgtgtggaaa

SEQ ID NO: 291 - DNA, 20 bp, Artificial sequence
  Synthetic oligonucleotide
agaaattagagccaggttcc

SEQ ID NO: 292 - DNA, 20 bp, Artificial sequence
  Synthetic oligonucleotide
tccccccagaaggcttgact

SEQ ID NO: 293 - DNA, 20 bp, Artificial sequence
  Synthetic oligonucleotide
tcgctggccatttcatatat

SEQ ID NO: 294 - DNA, 20 bp, Artificial sequence
  Synthetic oligonucleotide
aaaacatgttaactgttatc

SEQ ID NO: 295 - DNA, 20 bp, Artificial sequence
  Synthetic oligonucleotide
ttagccatgtgctttgtgac

SEQ ID NO: 296 - DNA, 20 bp, Artificial sequence
  Synthetic oligonucleotide
tcccttctgtcatctgatct

SEQ ID NO: 297 - DNA, 20 bp, Artificial sequence
  Synthetic oligonucleotide
aaggtagttctcccttctgt

SEQ ID NO: 298 - DNA, 20 bp, Artificial sequence
  Synthetic oligonucleotide
ttccattgcactcctttcta

SEQ ID NO: 299 - DNA, 20 bp, Artificial sequence
  Synthetic oligonucleotide
taaaaggaaaacccacttgt

SEQ ID NO: 300 - DNA, 20 bp, Artificial sequence
  Synthetic oligonucleotide
tacagaaattaccagtaaag

SEQ ID NO: 301 - DNA, 20 bp, Artificial sequence
  Synthetic oligonucleotide
tccagatttctacagaaatt

SEQ ID NO: 302 - DNA, 20 bp, Artificial sequence
  Synthetic oligonucleotide
tcactgcacactgtacagga

SEQ ID NO: 303 - DNA, 20 bp, Artificial sequence
  Synthetic oligonucleotide
tgcctagttccctcctgaaa

SEQ ID NO: 304 - DNA, 20 bp, Artificial sequence
  Synthetic oligonucleotide
ttatgtttacttcatgactg

SEQ ID NO: 305 - DNA, 20 bp, Artificial sequence
  Synthetic oligonucleotide
cttcattattctctagtgcc

SEQ ID NO: 306 - DNA, 20 bp, Artificial sequence
  Synthetic oligonucleotide
ctattccccttcaacatgtg

SEQ ID NO: 307 - DNA, 20 bp, Artificial sequence
  Synthetic oligonucleotide
catacccaacatgcttgcat

SEQ ID NO: 308 - DNA, 20 bp, Artificial sequence
  Synthetic oligonucleotide
aatgcattaccctacaatgc

SEQ ID NO: 309 - DNA, 20 bp, Artificial sequence
  Synthetic oligonucleotide
ctcatcacaactgggtggta

SEQ ID NO: 310 - DNA, 20 bp, Artificial sequence
  Synthetic oligonucleotide
atcccagctcatcacaactg

SEQ ID NO: 311 - DNA, 20 bp, Artificial sequence
  Synthetic oligonucleotide
tccaagtgcttcaagctgag

SEQ ID NO: 312 - DNA, 20 bp, Artificial sequence
  Synthetic oligonucleotide
cacccacagcaggcagataa

SEQ ID NO: 313 - DNA, 20 bp, Artificial sequence
  Synthetic oligonucleotide
taccttgctccaaaataatc

SEQ ID NO: 314 - DNA, 20 bp, Artificial sequence
  Synthetic oligonucleotide
ctgtttcttgaggcaaatga

SEQ ID NO: 315 - DNA, 20 bp, Artificial sequence
  Synthetic oligonucleotide
cttttctcaatgtcaactct

SEQ ID NO: 316 - DNA, 20 bp, Artificial sequence
  Synthetic oligonucleotide
agagttatacacggaaccca

SEQ ID NO: 317 - DNA, 20 bp, Artificial sequence
  Synthetic oligonucleotide
ttctagggctccagtttatg

SEQ ID NO: 318 - DNA, 20 bp, Artificial sequence
  Synthetic oligonucleotide
tggtcatctcgggtatataa

SEQ ID NO: 319 - DNA, 20 bp, Artificial sequence
  Synthetic oligonucleotide
cttactatcttcaagaattc

SEQ ID NO: 320 - DNA, 20 bp, Artificial sequence
  Synthetic oligonucleotide
tttttcttactatcttcaag

SEQ ID NO: 321 - DNA, 20 bp, Artificial sequence
  Synthetic oligonucleotide
agtcaattgtcagacttatt

SEQ ID NO: 322 - DNA, 20 bp, Artificial sequence
  Synthetic oligonucleotide
aaggagttcctttagcattt

SEQ ID NO: 323 - DNA, 20 bp, Artificial sequence
  Synthetic oligonucleotide
cagaccgaaggagttccttt

SEQ ID NO: 324 - DNA, 20 bp, Artificial sequence
  Synthetic oligonucleotide
tccagtgcctttctatttca

SEQ ID NO: 325 - DNA, 20 bp, Artificial sequence
  Synthetic oligonucleotide
actttgttttaaacttacac

SEQ ID NO: 326 - DNA, 20 bp, Artificial sequence
  Synthetic oligonucleotide
catcaacacaagtttataat

SEQ ID NO: 327 - DNA, 20 bp, Artificial sequence
  Synthetic oligonucleotide
aactcccacaaggtactctt

SEQ ID NO: 328 - DNA, 20 bp, Artificial sequence
  Synthetic oligonucleotide
actgtcaactcctgaactcc

SEQ ID NO: 329 - DNA, 20 bp, Artificial sequence
  Synthetic oligonucleotide
caatgaatctattcttagat

SEQ ID NO: 330 - DNA, 20 bp, Artificial sequence
  Synthetic oligonucleotide
gtgaaactgtttataccctt

SEQ ID NO: 331 - DNA, 20 bp, Artificial sequence
  Synthetic oligonucleotide
gttggtgatgcaggtaaagt

SEQ ID NO: 332 - DNA, 20 bp, Artificial sequence
  Synthetic oligonucleotide
ttgttactgagctgtgccac

SEQ ID NO: 333 - DNA, 20 bp, Artificial sequence
  Synthetic oligonucleotide
aagtggatctcttgggcagg

SEQ ID NO: 334 - DNA, 20 bp, Artificial sequence
  Synthetic oligonucleotide
tttaccctctcccaaccact

SEQ ID NO: 335 - DNA, 20 bp, Artificial sequence
  Synthetic oligonucleotide
ggctgctgtttgagtcccca

SEQ ID NO: 336 - DNA, 20 bp, Artificial sequence
  Synthetic oligonucleotide
atgggctgctgtttgagtcc

SEQ ID NO: 337 - DNA, 20 bp, Artificial sequence
  Synthetic oligonucleotide
tatgggctgctgtttgagtc

SEQ ID NO: 338 - DNA, 20 bp, Artificial sequence
  Synthetic oligonucleotide
aaagccaggccaggtgctga

SEQ ID NO: 339 - DNA, 20 bp, Artificial sequence
  Synthetic oligonucleotide
cataaagccaggccaggtgc

SEQ ID NO: 340 - DNA, 20 bp, Artificial sequence
  Synthetic oligonucleotide
tgcataaagccaggccaggt

SEQ ID NO: 341 - DNA, 20 bp, Artificial sequence
  Synthetic oligonucleotide
ggttgcataaagccaggcca

SEQ ID NO: 342 - DNA, 20 bp, Artificial sequence
  Synthetic oligonucleotide
tctaggttgcataaagccag

SEQ ID NO: 343 - DNA, 20 bp, Artificial sequence
  Synthetic oligonucleotide
ttctctaggttgcataaagc

SEQ ID NO: 344 - DNA, 20 bp, Artificial sequence
  Synthetic oligonucleotide
ccttctctaggttgcataaa

SEQ ID NO: 345 - DNA, 20 bp, Artificial sequence
  Synthetic oligonucleotide
tcaccttctctaggttgcat

SEQ ID NO: 346 - DNA, 20 bp, Artificial sequence
  Synthetic oligonucleotide
tatcaccttctctaggttgc

SEQ ID NO: 347 - DNA, 20 bp, Artificial sequence
  Synthetic oligonucleotide
cacatcttgttccctcaagg

SEQ ID NO: 348 - DNA, 20 bp, Artificial sequence
  Synthetic oligonucleotide
ttcacacatcttgttccctc

SEQ ID NO: 349 - DNA, 20 bp, Artificial sequence
  Synthetic oligonucleotide
tgcttcacacatcttgttcc

SEQ ID NO: 350 - DNA, 20 bp, Artificial sequence
  Synthetic oligonucleotide
cctgcttcacacatcttgtt

SEQ ID NO: 351 - DNA, 20 bp, Artificial sequence
  Synthetic oligonucleotide
gaacctgcttcacacatctt

SEQ ID NO: 352 - DNA, 20 bp, Artificial sequence
  Synthetic oligonucleotide
ctttcatcagttagtcaggt

SEQ ID NO: 353 - DNA, 20 bp, Artificial sequence
  Synthetic oligonucleotide
ggagttggttattggaaaat

SEQ ID NO: 354 - DNA, 20 bp, Artificial sequence
  Synthetic oligonucleotide
tctattggtgttccttttag

SEQ ID NO: 355 - DNA, 20 bp, Artificial sequence
  Synthetic oligonucleotide
agagtagtctattggtgttc

SEQ ID NO: 356 - DNA, 20 bp, Artificial sequence
  Synthetic oligonucleotide
cttttaagataatttttctc

SEQ ID NO: 357 - DNA, 20 bp, Artificial sequence
  Synthetic oligonucleotide
tacgctccttcatttcatgc

SEQ ID NO: 358 - DNA, 20 bp, Artificial sequence
  Synthetic oligonucleotide
tttttaatcctctgatgaat

SEQ ID NO: 359 - DNA, 20 bp, Artificial sequence
  Synthetic oligonucleotide
ctctcttctcctttatgact

SEQ ID NO: 360 - DNA, 20 bp, Artificial sequence
  Synthetic oligonucleotide
cttaaataagttttctaccc

SEQ ID NO: 361 - DNA, 20 bp, Artificial sequence
  Synthetic oligonucleotide
agccattatttcttaaataa

SEQ ID NO: 362 - DNA, 20 bp, Artificial sequence
  Synthetic oligonucleotide
catatcttttcctagatttg

SEQ ID NO: 363 - DNA, 20 bp, Artificial sequence
  Synthetic oligonucleotide
agaatcctgtctccctctta

SEQ ID NO: 364 - DNA, 20 bp, Artificial sequence
  Synthetic oligonucleotide
tgagtctcttttctttcggt

SEQ ID NO: 365 - DNA, 20 bp, Artificial sequence
  Synthetic oligonucleotide
tgatgagtctcttttctttc

SEQ ID NO: 366 - DNA, 20 bp, Artificial sequence
  Synthetic oligonucleotide
tgtgatgagtctcttttctt

SEQ ID NO: 367 - DNA, 20 bp, Artificial sequence
  Synthetic oligonucleotide
tactgagaaatctcttgaat

SEQ ID NO: 368 - DNA, 20 bp, Artificial sequence
  Synthetic oligonucleotide
taaaattatttatacaccat

SEQ ID NO: 369 - DNA, 20 bp, Artificial sequence
  Synthetic oligonucleotide
tttatactgtagtatgcatt

SEQ ID NO: 370 - DNA, 20 bp, Artificial sequence
  Synthetic oligonucleotide
ttacttccctacccttgcat

SEQ ID NO: 371 - DNA, 20 bp, Artificial sequence
  Synthetic oligonucleotide
cttttacttccctacccttg

SEQ ID NO: 372 - DNA, 20 bp, Artificial sequence
  Synthetic oligonucleotide
atttattttaagctgataac

SEQ ID NO: 373 - DNA, 20 bp, Artificial sequence
  Synthetic oligonucleotide
aaatccatttgtccagtctg

SEQ ID NO: 374 - DNA, 20 bp, Artificial sequence
  Synthetic oligonucleotide
tatctgcatgcaatatcttt

SEQ ID NO: 375 - DNA, 20 bp, Artificial sequence
  Synthetic oligonucleotide
ctgtaagtatagatgcctct

SEQ ID NO: 376 - DNA, 20 bp, Artificial sequence
  Synthetic oligonucleotide
ttagccttttgatatagttt

SEQ ID NO: 377 - DNA, 20 bp, Artificial sequence
  Synthetic oligonucleotide
gcttcaccattttgaccttc

SEQ ID NO: 378 - DNA, 20 bp, Artificial sequence
  Synthetic oligonucleotide
ttttgaaagggaggcactga

SEQ ID NO: 379 - DNA, 20 bp, Artificial sequence
  Synthetic oligonucleotide
tgaggtgtaatgttgtttat

SEQ ID NO: 380 - DNA, 20 bp, Artificial sequence
  Synthetic oligonucleotide
taatagtctctattgttttt

SEQ ID NO: 381 - DNA, 20 bp, Artificial sequence
  Synthetic oligonucleotide
caagttaactaatatgttgg

SEQ ID NO: 382 - DNA, 20 bp, Artificial sequence
  Synthetic oligonucleotide
tattgattcaattcccttat

SEQ ID NO: 383 - DNA, 20 bp, Artificial sequence
  Synthetic oligonucleotide
gaatattgattcaattccct

SEQ ID NO: 384 - DNA, 20 bp, Artificial sequence
  Synthetic oligonucleotide
aatttttttaaatggttggc

SEQ ID NO: 385 - DNA, 20 bp, Artificial sequence
  Synthetic oligonucleotide
aacagagaattgtatatcca

SEQ ID NO: 386 - DNA, 20 bp, Artificial sequence
  Synthetic oligonucleotide
acatgagatctttaataaga

SEQ ID NO: 387 - DNA, 20 bp, Artificial sequence
  Synthetic oligonucleotide
caagagagaagccactcatg

SEQ ID NO: 388 - DNA, 20 bp, Artificial sequence
  Synthetic oligonucleotide
agcagatttgagctggaaga

SEQ ID NO: 389 - DNA, 20 bp, Artificial sequence
  Synthetic oligonucleotide
aactggcagaaaatatctct

SEQ ID NO: 390 - DNA, 20 bp, Artificial sequence
  Synthetic oligonucleotide
aaagaagaacataaactggc

SEQ ID NO: 391 - DNA, 20 bp, Artificial sequence
  Synthetic oligonucleotide
gttggctctattttcaaatg

SEQ ID NO: 392 - DNA, 20 bp, Artificial sequence
  Synthetic oligonucleotide
ctgtttaggctggacactgt

SEQ ID NO: 393 - DNA, 20 bp, Artificial sequence
  Synthetic oligonucleotide
attcaggaaattaaagcatt

SEQ ID NO: 394 - DNA, 20 bp, Artificial sequence
  Synthetic oligonucleotide
agcagaacagaccttatttg

SEQ ID NO: 395 - DNA, 20 bp, Artificial sequence
  Synthetic oligonucleotide
ccttcaaccagaggagcaga

SEQ ID NO: 396 - DNA, 20 bp, Artificial sequence
  Synthetic oligonucleotide
gatcttggtttgtagaaggt

SEQ ID NO: 397 - DNA, 20 bp, Artificial sequence
  Synthetic oligonucleotide
ttcaaaatggtagaaaattg

SEQ ID NO: 398 - DNA, 20 bp, Artificial sequence
  Synthetic oligonucleotide
tgaaaggcctacagcaacca

SEQ ID NO: 399 - DNA, 20 bp, Artificial sequence
  Synthetic oligonucleotide
atgggagctctggaaaacag

SEQ ID NO: 400 - DNA, 20 bp, Artificial sequence
  Synthetic oligonucleotide
ttctgagtatatgtgaaaca

SEQ ID NO: 401 - DNA, 20 bp, Artificial sequence
  Synthetic oligonucleotide
ataaggagattaatttaaga

SEQ ID NO: 402 - DNA, 20 bp, Artificial sequence
  Synthetic oligonucleotide
gaatcaaagaaagaaggaat

SEQ ID NO: 403 - DNA, 20 bp, Artificial sequence
  Synthetic oligonucleotide
gctgtaataataatcatatt

SEQ ID NO: 404 - DNA, 20 bp, Artificial sequence
  Synthetic oligonucleotide
agaattcttccctacaggtt

SEQ ID NO: 405 - DNA, 20 bp, Artificial sequence
  Synthetic oligonucleotide
cagtaattaatgttcttata

SEQ ID NO: 406 - DNA, 20 bp, Artificial sequence
  Synthetic oligonucleotide
ccccaattcagtaattaatg

SEQ ID NO: 407 - DNA, 20 bp, Artificial sequence
  Synthetic oligonucleotide
ggccccaattcagtaattaa

SEQ ID NO: 408 - DNA, 20 bp, Artificial sequence
  Synthetic oligonucleotide
atgtaacctattcaagatga

SEQ ID NO: 409 - DNA, 20 bp, Artificial sequence
  Synthetic oligonucleotide
ttatttggaagaagaatctt

SEQ ID NO: 410 - DNA, 20 bp, Artificial sequence
  Synthetic oligonucleotide
tataaaatactttttatggg

SEQ ID NO: 411 - DNA, 20 bp, Artificial sequence
  Synthetic oligonucleotide
gactgtgataaagatgtata

SEQ ID NO: 412 - DNA, 20 bp, Artificial sequence
  Synthetic oligonucleotide
taagggtcatgtactataca

SEQ ID NO: 413 - DNA, 20 bp, Artificial sequence
  Synthetic oligonucleotide
gtgtgtgcaatagcctaaat

SEQ ID NO: 414 - DNA, 20 bp, Artificial sequence
  Synthetic oligonucleotide
cagaagcaaaagatagcagc

SEQ ID NO: 415 - DNA, 20 bp, Artificial sequence
  Synthetic oligonucleotide
tattaatgtacttgaagatg

SEQ ID NO: 416 - DNA, 20 bp, Artificial sequence
  Synthetic oligonucleotide
atcagtgtgtgcagattctg

SEQ ID NO: 417 - DNA, 20 bp, Artificial sequence
  Synthetic oligonucleotide
tcccatcatcagtgtgtgca

SEQ ID NO: 418 - DNA, 20 bp, Artificial sequence
  Synthetic oligonucleotide
tatgaaaattaatgttcaag

SEQ ID NO: 419 - DNA, 20 bp, Artificial sequence
  Synthetic oligonucleotide
aaaaaattttaaacccctag

SEQ ID NO: 420 - DNA, 20 bp, Artificial sequence
  Synthetic oligonucleotide
tcatgaaagtagagagtaag

SEQ ID NO: 421 - DNA, 20 bp, Artificial sequence
  Synthetic oligonucleotide
tgaaacaatttaagtgccca

SEQ ID NO: 422 - DNA, 20 bp, Artificial sequence
  Synthetic oligonucleotide
ttgaagggatatcttcattc

SEQ ID NO: 423 - DNA, 20 bp, Artificial sequence
  Synthetic oligonucleotide
tctgaaaaaaatagaacaac

SEQ ID NO: 424 - DNA, 20 bp, Artificial sequence
  Synthetic oligonucleotide
aataaaagacctgcacagca

SEQ ID NO: 425 - DNA, 20 bp, Artificial sequence
  Synthetic oligonucleotide
caaaataaaagacctgcaca

SEQ ID NO: 426 - DNA, 20 bp, Artificial sequence
  Synthetic oligonucleotide
agacccttatttacaccata

SEQ ID NO: 427 - DNA, 20 bp, Artificial sequence
  Synthetic oligonucleotide
ctattaatgagctatctgaa

SEQ ID NO: 428 - DNA, 20 bp, Artificial sequence
  Synthetic oligonucleotide
tctactattaatgagctatc

SEQ ID NO: 429 - DNA, 20 bp, Artificial sequence
  Synthetic oligonucleotide
tttccatctactattaatga

SEQ ID NO: 430 - DNA, 20 bp, Artificial sequence
  Synthetic oligonucleotide
gtctccaccagaacaaaact

SEQ ID NO: 431 - DNA, 20 bp, Artificial sequence
  Synthetic oligonucleotide
atgacataaccatatacaaa

SEQ ID NO: 432 - DNA, 20 bp, Artificial sequence
  Synthetic oligonucleotide
ttactgatgacataaccata

SEQ ID NO: 433 - DNA, 20 bp, Artificial sequence
  Synthetic oligonucleotide
caaaattcaacctggtttca

SEQ ID NO: 434 - DNA, 20 bp, Artificial sequence
  Synthetic oligonucleotide
atggagggtgtaaatcaaat

SEQ ID NO: 435 - DNA, 20 bp, Artificial sequence
  Synthetic oligonucleotide
tgttacactgttattaaagc

SEQ ID NO: 436 - DNA, 20 bp, Artificial sequence
  Synthetic oligonucleotide
aaaacaatgaagcagaggga

SEQ ID NO: 437 - DNA, 20 bp, Artificial sequence
  Synthetic oligonucleotide
taataaaaagtatcccacca

SEQ ID NO: 438 - DNA, 20 bp, Artificial sequence
  Synthetic oligonucleotide
gaagttatgcaccatcaaat

SEQ ID NO: 439 - DNA, 20 bp, Artificial sequence
  Synthetic oligonucleotide
tttactactgatatcaccaa

SEQ ID NO: 440 - DNA, 20 bp, Artificial sequence
  Synthetic oligonucleotide
agaacagactaagcccgaaa

SEQ ID NO: 441 - DNA, 20 bp, Artificial sequence
  Synthetic oligonucleotide
aattctggtggaaaatacag

SEQ ID NO: 442 - DNA, 20 bp, Artificial sequence
  Synthetic oligonucleotide
acagaaatcatatcaaatcc

SEQ ID NO: 443 - DNA, 20 bp, Artificial sequence
  Synthetic oligonucleotide
atatatgaaacattccatcc

SEQ ID NO: 444 - DNA, 20 bp, Artificial sequence
  Synthetic oligonucleotide
ttacactttagaccaaacgg

SEQ ID NO: 445 - DNA, 20 bp, Artificial sequence
  Synthetic oligonucleotide
gggcagattgatcacctaga

SEQ ID NO: 446 - DNA, 20 bp, Artificial sequence
  Synthetic oligonucleotide
cgggacctcaatactctact

SEQ ID NO: 447 - DNA, 20 bp, Artificial sequence
  Synthetic oligonucleotide
taaatggaaattgagagcag

SEQ ID NO: 448 - DNA, 20 bp, Artificial sequence
  Synthetic oligonucleotide
aagtcacaaccacatactgc

SEQ ID NO: 449 - DNA, 20 bp, Artificial sequence
  Synthetic oligonucleotide
gattctccaacaaaaagaca

SEQ ID NO: 450 - DNA, 20 bp, Artificial sequence
  Synthetic oligonucleotide
gacactagcagtttcttacc

SEQ ID NO: 451 - DNA, 20 bp, Artificial sequence
  Synthetic oligonucleotide
gcttaaagtagcctaaggat

SEQ ID NO: 452 - DNA, 20 bp, Artificial sequence
  Synthetic oligonucleotide
acaataagttgtagctacaa

SEQ ID NO: 453 - DNA, 20 bp, Artificial sequence
  Synthetic oligonucleotide
ttaaaaacaactgtagctac

SEQ ID NO: 454 - DNA, 20 bp, Artificial sequence
  Synthetic oligonucleotide
ttcctattaggaggtttaaa

SEQ ID NO: 455 - DNA, 20 bp, Artificial sequence
  Synthetic oligonucleotide
ataagtaattcatagtcaga

SEQ ID NO: 456 - DNA, 20 bp, Artificial sequence
  Synthetic oligonucleotide
ggcttaaataaaagactgct

SEQ ID NO: 457 - DNA, 20 bp, Artificial sequence
  Synthetic oligonucleotide
taagattccattgccagaat

SEQ ID NO: 458 - DNA, 20 bp, Artificial sequence
  Synthetic oligonucleotide
aagtttcgcaataagattcc

SEQ ID NO: 459 - DNA, 20 bp, Artificial sequence
  Synthetic oligonucleotide
tttcagtcagcaaaggcagc

SEQ ID NO: 460 - DNA, 20 bp, Artificial sequence
  Synthetic oligonucleotide
tctcaaccctgaaaacaatc

SEQ ID NO: 461 - DNA, 20 bp, Artificial sequence
  Synthetic oligonucleotide
cattggcattattcacagca

SEQ ID NO: 462 - DNA, 20 bp, Artificial sequence
  Synthetic oligonucleotide
ctgactgtcattcatataag

SEQ ID NO: 463 - DNA, 20 bp, Artificial sequence
  Synthetic oligonucleotide
tgcataacgataatcatgtg

SEQ ID NO: 464 - DNA, 20 bp, Artificial sequence
  Synthetic oligonucleotide
ttgtagatcctggcaagtat

SEQ ID NO: 465 - DNA, 20 bp, Artificial sequence
  Synthetic oligonucleotide
aaaaataaagtttccctctt

SEQ ID NO: 466 - DNA, 20 bp, Artificial sequence
  Synthetic oligonucleotide
caaaacttgtcaacattata

SEQ ID NO: 467 - DNA, 20 bp, Artificial sequence
  Synthetic oligonucleotide
ctatatttagaccaaatgag

SEQ ID NO: 468 - DNA, 20 bp, Artificial sequence
  Synthetic oligonucleotide
ctgacatatataaattagaa

SEQ ID NO: 469 - DNA, 20 bp, Artificial sequence
  Synthetic oligonucleotide
catagcaacctgacatatat

SEQ ID NO: 470 - DNA, 20 bp, Artificial sequence
  Synthetic oligonucleotide
acaaacattgtaaaaacata

SEQ ID NO: 471 - DNA, 20 bp, Artificial sequence
  Synthetic oligonucleotide
ttagaacatgtagccataat

SEQ ID NO: 472 - DNA, 20 bp, Artificial sequence
  Synthetic oligonucleotide
aattgtatttaatttaatga

SEQ ID NO: 473 - DNA, 20 bp, Artificial sequence
  Synthetic oligonucleotide
atcatactggagccaggtga

SEQ ID NO: 474 - DNA, 20 bp, Artificial sequence
  Synthetic oligonucleotide
aatgcagaaataagaccttc

SEQ ID NO: 475 - DNA, 20 bp, Artificial sequence
  Synthetic oligonucleotide
cagtcatccttatctaaggg

SEQ ID NO: 476 - DNA, 20 bp, Artificial sequence
  Synthetic oligonucleotide
aagccaaagagtactcttcc

SEQ ID NO: 477 - DNA, 20 bp, Artificial sequence
  Synthetic oligonucleotide
gatatctgggtgtgtcagct

SEQ ID NO: 478 - DNA, 20 bp, Artificial sequence
  Synthetic oligonucleotide
caacataaggtcttattgtt

SEQ ID NO: 479 - DNA, 20 bp, Artificial sequence
  Synthetic oligonucleotide
ggtcttctagaagctaatag

SEQ ID NO: 480 - DNA, 20 bp, Artificial sequence
  Synthetic oligonucleotide
ttgataagtggtcttctaga

SEQ ID NO: 481 - DNA, 20 bp, Artificial sequence
  Synthetic oligonucleotide
caattcttttgagtgtgtac

SEQ ID NO: 482 - DNA, 20 bp, Artificial sequence
  Synthetic oligonucleotide
tcaattcttttgagtgtgta

SEQ ID NO: 483 - DNA, 20 bp, Artificial sequence
  Synthetic oligonucleotide
gtgtgacattgtcatcatac

SEQ ID NO: 484 - DNA, 20 bp, Artificial sequence
  Synthetic oligonucleotide
ctttatgctttctgttcttt

SEQ ID NO: 485 - DNA, 20 bp, Artificial sequence
  Synthetic oligonucleotide
gagactctctttgtttcttt

SEQ ID NO: 486 - DNA, 20 bp, Artificial sequence
  Synthetic oligonucleotide
ttcattggaattcattgagc

SEQ ID NO: 487 - DNA, 20 bp, Artificial sequence
  Synthetic oligonucleotide
caagactttcttcttgtttt

SEQ ID NO: 488 - DNA, 20 bp, Artificial sequence
  Synthetic oligonucleotide
agtcagctgttaatcttcct

SEQ ID NO: 489 - DNA, 20 bp, Artificial sequence
  Synthetic oligonucleotide
tttttctttgagcattttta

SEQ ID NO: 490 - DNA, 20 bp, Artificial sequence
  Synthetic oligonucleotide
tttaagtatttagagaactc

SEQ ID NO: 491 - DNA, 20 bp, Artificial sequence
  Synthetic oligonucleotide
tacctaggctcacttgcttt

SEQ ID NO: 492 - DNA, 20 bp, Artificial sequence
  Synthetic oligonucleotide
tagttgttgatttgaataac

SEQ ID NO: 493 - DNA, 20 bp, Artificial sequence
  Synthetic oligonucleotide
tgtagttgttgatttgaata

SEQ ID NO: 494 - DNA, 20 bp, Artificial sequence
  Synthetic oligonucleotide
ttattttaaaatcacttcag

SEQ ID NO: 495 - DNA, 20 bp, Artificial sequence
  Synthetic oligonucleotide
tcttctttggcaaatatatt

SEQ ID NO: 496 - DNA, 20 bp, Artificial sequence
  Synthetic oligonucleotide
tccctttttgccatcttttg

SEQ ID NO: 497 - DNA, 20 bp, Artificial sequence
  Synthetic oligonucleotide
aataagtttctaatttacac

SEQ ID NO: 498 - DNA, 20 bp, Artificial sequence
  Synthetic oligonucleotide
tctcatgtgtttttgttcct

SEQ ID NO: 499 - DNA, 20 bp, Artificial sequence
  Synthetic oligonucleotide
taaacctggagattttatcc

SEQ ID NO: 500 - DNA, 20 bp, Artificial sequence
  Synthetic oligonucleotide
gggaacacaccattcagcag

SEQ ID NO: 501 - DNA, 20 bp, Artificial sequence
  Synthetic oligonucleotide
aatcttgttgactaaaagta

SEQ ID NO: 502 - DNA, 20 bp, Artificial sequence
  Synthetic oligonucleotide
gtctcacgctgtgtgaatca

SEQ ID NO: 503 - DNA, 20 bp, Artificial sequence
  Synthetic oligonucleotide
aggtctcacgctgtgtgaat

SEQ ID NO: 504 - DNA, 20 bp, Artificial sequence
  Synthetic oligonucleotide
tgctcctatttcaatatgag

SEQ ID NO: 505 - DNA, 20 bp, Artificial sequence
  Synthetic oligonucleotide
ataaggttcaaaagccggtg

SEQ ID NO: 506 - DNA, 20 bp, Artificial sequence
  Synthetic oligonucleotide
aactggtaacataaatgcag

SEQ ID NO: 507 - DNA, 20 bp, Artificial sequence
  Synthetic oligonucleotide
tcagagcaaaatggactgac

SEQ ID NO: 508 - DNA, 20 bp, Artificial sequence
  Synthetic oligonucleotide
tacaaatacccagtctgcag

SEQ ID NO: 509 - DNA, 20 bp, Artificial sequence
  Synthetic oligonucleotide
aaggcccttatcatatgcca

SEQ ID NO: 510 - DNA, 20 bp, Artificial sequence
  Synthetic oligonucleotide
tcctataaaagaagatattt

SEQ ID NO: 511 - DNA, 20 bp, Artificial sequence
  Synthetic oligonucleotide
ctgtgagagctctgccctca

SEQ ID NO: 512 - DNA, 20 bp, Artificial sequence
  Synthetic oligonucleotide
gttaatagtgttcttacatc

SEQ ID NO: 513 - DNA, 20 bp, Artificial sequence
  Synthetic oligonucleotide
cagtggagtcaagttggtta

SEQ ID NO: 514 - DNA, 20 bp, Artificial sequence
  Synthetic oligonucleotide
tctactagctaactttatca

SEQ ID NO: 515 - DNA, 20 bp, Artificial sequence
  Synthetic oligonucleotide
aggatcaaagcagaaattaa

SEQ ID NO: 516 - DNA, 20 bp, Artificial sequence
  Synthetic oligonucleotide
aaaaacatagactttactaa

SEQ ID NO: 517 - DNA, 20 bp, Artificial sequence
  Synthetic oligonucleotide
cacaaaaaactgattatata

SEQ ID NO: 518 - DNA, 20 bp, Artificial sequence
  Synthetic oligonucleotide
gatctgtgttgttcttaagt

SEQ ID NO: 519 - DNA, 20 bp, Artificial sequence
  Synthetic oligonucleotide
aaggtagattttatggctac

SEQ ID NO: 520 - DNA, 20 bp, Artificial sequence
  Synthetic oligonucleotide
gggcaaaaatagcaacataa

SEQ ID NO: 521 - DNA, 20 bp, Artificial sequence
  Synthetic oligonucleotide
aagacatagatgatcccata

SEQ ID NO: 522 - DNA, 20 bp, Artificial sequence
  Synthetic oligonucleotide
tatgagatgtaaggagacaa

SEQ ID NO: 523 - DNA, 20 bp, Artificial sequence
  Synthetic oligonucleotide
gataggagtaatcttttttt

SEQ ID NO: 524 - DNA, 20 bp, Artificial sequence
  Synthetic oligonucleotide
aaacaaaaactctcctaagt

SEQ ID NO: 525 - DNA, 20 bp, Artificial sequence
  Synthetic oligonucleotide
agaactaacagaattaagag

SEQ ID NO: 526 - DNA, 20 bp, Artificial sequence
  Synthetic oligonucleotide
cagaactaacagaattaaga

SEQ ID NO: 527 - DNA, 20 bp, Artificial sequence
  Synthetic oligonucleotide
acacagaactaacagaatta

SEQ ID NO: 528 - DNA, 20 bp, Artificial sequence
  Synthetic oligonucleotide
aaaaagaggaaaaccgaaag

SEQ ID NO: 529 - DNA, 20 bp, Artificial sequence
  Synthetic oligonucleotide
catacaaatgtcactaatat

SEQ ID NO: 530 - DNA, 20 bp, Artificial sequence
  Synthetic oligonucleotide
aagactagcatacaaatgtc

SEQ ID NO: 531 - DNA, 20 bp, Artificial sequence
  Synthetic oligonucleotide
acaggtgtatattccctatc

SEQ ID NO: 532 - DNA, 20 bp, Artificial sequence
  Synthetic oligonucleotide
atatatctactgaatatgat

SEQ ID NO: 533 - DNA, 20 bp, Artificial sequence
  Synthetic oligonucleotide
ctcagaaccctttggtctaa

SEQ ID NO: 534 - DNA, 20 bp, Artificial sequence
  Synthetic oligonucleotide
ctgacttgactttaatgaaa

SEQ ID NO: 535 - DNA, 20 bp, Artificial sequence
  Synthetic oligonucleotide
gcattcagcttatagcagaa

SEQ ID NO: 536 - DNA, 20 bp, Artificial sequence
  Synthetic oligonucleotide
ctgcattcagcttatagcag

SEQ ID NO: 537 - DNA, 20 bp, Artificial sequence
  Synthetic oligonucleotide
aaacattcctcataccacac

SEQ ID NO: 538 - DNA, 20 bp, Artificial sequence
  Synthetic oligonucleotide
cttatccttgatccagacaa

SEQ ID NO: 539 - DNA, 20 bp, Artificial sequence
  Synthetic oligonucleotide
aatgggaaatgctaaagttg

SEQ ID NO: 540 - DNA, 20 bp, Artificial sequence
  Synthetic oligonucleotide
agtgacacagtagttgtatc

SEQ ID NO: 541 - DNA, 20 bp, Artificial sequence
  Synthetic oligonucleotide
caatttcctctctaccaagc

SEQ ID NO: 542 - DNA, 20 bp, Artificial sequence
  Synthetic oligonucleotide
ctttgtcatttcatttataa

SEQ ID NO: 543 - DNA, 20 bp, Artificial sequence
  Synthetic oligonucleotide
atacaggcatctcagccctc

SEQ ID NO: 544 - DNA, 20 bp, Artificial sequence
  Synthetic oligonucleotide
aaagtaccaaagtggctgct

SEQ ID NO: 545 - DNA, 20 bp, Artificial sequence
  Synthetic oligonucleotide
aaaagtaccaaagtggctgc

SEQ ID NO: 546 - DNA, 20 bp, Artificial sequence
  Synthetic oligonucleotide
gaaataatgaactcacagtc

SEQ ID NO: 547 - DNA, 20 bp, Artificial sequence
  Synthetic oligonucleotide
cacagttgtttaggtcatct

SEQ ID NO: 548 - DNA, 20 bp, Artificial sequence
  Synthetic oligonucleotide
gcatgccatatttccttctt

SEQ ID NO: 549 - DNA, 20 bp, Artificial sequence
  Synthetic oligonucleotide
atagaggcatgccatatttc

SEQ ID NO: 550 - DNA, 20 bp, Artificial sequence
  Synthetic oligonucleotide
agcaaaaataatcttagaaa

SEQ ID NO: 551 - DNA, 20 bp, Artificial sequence
  Synthetic oligonucleotide
gattccaggccttctatctc

SEQ ID NO: 552 - DNA, 20 bp, Artificial sequence
  Synthetic oligonucleotide
ggtctcaatgaggaaaagga

SEQ ID NO: 553 - DNA, 20 bp, Artificial sequence
  Synthetic oligonucleotide
ataaaagcaaaagagagtta

SEQ ID NO: 554 - DNA, 20 bp, Artificial sequence
  Synthetic oligonucleotide
tctattctgaaaccccaata

SEQ ID NO: 555 - DNA, 20 bp, Artificial sequence
  Synthetic oligonucleotide
gacatgccatcaagagaaga

SEQ ID NO: 556 - DNA, 20 bp, Artificial sequence
  Synthetic oligonucleotide
atgtattaaccaatattttg

SEQ ID NO: 557 - DNA, 20 bp, Artificial sequence
  Synthetic oligonucleotide
agaacccacttgatctatta

SEQ ID NO: 558 - DNA, 20 bp, Artificial sequence
  Synthetic oligonucleotide
taaagaattgagtaccaaaa

SEQ ID NO: 559 - DNA, 20 bp, Artificial sequence
  Synthetic oligonucleotide
tatcacattaattccctctc

SEQ ID NO: 560 - DNA, 20 bp, Artificial sequence
  Synthetic oligonucleotide
tagaatagaaaagcatgaag

SEQ ID NO: 561 - DNA, 20 bp, Artificial sequence
  Synthetic oligonucleotide
aacaactatatttgcttgta

SEQ ID NO: 562 - DNA, 20 bp, Artificial sequence
  Synthetic oligonucleotide
ataatcacactaaatcttaa

SEQ ID NO: 563 - DNA, 20 bp, Artificial sequence
  Synthetic oligonucleotide
cctctattaagatctatgag

SEQ ID NO: 564 - DNA, 20 bp, Artificial sequence
  Synthetic oligonucleotide
acttcatcaatatttcccca

SEQ ID NO: 565 - DNA, 20 bp, Artificial sequence
  Synthetic oligonucleotide
gcacttaaatttatcagttg

SEQ ID NO: 566 - DNA, 20 bp, Artificial sequence
  Synthetic oligonucleotide
aagcacttaaatttatcagt

SEQ ID NO: 567 - DNA, 20 bp, Artificial sequence
  Synthetic oligonucleotide
ttagtatgtcgagaactcaa

SEQ ID NO: 568 - DNA, 20 bp, Artificial sequence
  Synthetic oligonucleotide
aagttgaaacacattttagc

SEQ ID NO: 569 - DNA, 20 bp, Artificial sequence
  Synthetic oligonucleotide
aggattaaaagttgaaacac

SEQ ID NO: 570 - DNA, 20 bp, Artificial sequence
  Synthetic oligonucleotide
caggattaaaagttgaaaca

SEQ ID NO: 571 - DNA, 20 bp, Artificial sequence
  Synthetic oligonucleotide
aatcagggaagcaggattaa

SEQ ID NO: 572 - DNA, 20 bp, Artificial sequence
  Synthetic oligonucleotide
tgattactcttggcagtaat

SEQ ID NO: 573 - DNA, 20 bp, Artificial sequence
  Synthetic oligonucleotide
tgatagatacttgtattagc

SEQ ID NO: 574 - DNA, 20 bp, Artificial sequence
  Synthetic oligonucleotide
caaatctaaagctcatttac

SEQ ID NO: 575 - DNA, 20 bp, Artificial sequence
  Synthetic oligonucleotide
ctaccaaaatgtcaaatcta

SEQ ID NO: 576 - DNA, 20 bp, Artificial sequence
  Synthetic oligonucleotide
gtaacctgaatatttcatga

SEQ ID NO: 577 - DNA, 20 bp, Artificial sequence
  Synthetic oligonucleotide
aaataatggtaacctgaata

SEQ ID NO: 578 - DNA, 20 bp, Artificial sequence
  Synthetic oligonucleotide
aatacattactgaaataatg

SEQ ID NO: 579 - DNA, 20 bp, Artificial sequence
  Synthetic oligonucleotide
tttaccttgacattctaata

SEQ ID NO: 580 - DNA, 20 bp, Artificial sequence
  Synthetic oligonucleotide
ttaacctattttaataatat

SEQ ID NO: 581 - DNA, 20 bp, Artificial sequence
  Synthetic oligonucleotide
ttaagtgattggaaataaaa

SEQ ID NO: 582 - DNA, 20 bp, Artificial sequence
  Synthetic oligonucleotide
caattaggaatatttaagtg

SEQ ID NO: 583 - DNA, 20 bp, Artificial sequence
  Synthetic oligonucleotide
ccaggcaatggctctttcaa

SEQ ID NO: 584 - DNA, 20 bp, Artificial sequence
  Synthetic oligonucleotide
tgtatagtttacccaggcaa

SEQ ID NO: 585 - DNA, 20 bp, Artificial sequence
  Synthetic oligonucleotide
ctttatcaatctaatcaatt

SEQ ID NO: 586 - DNA, 20 bp, Artificial sequence
  Synthetic oligonucleotide
actttatagtgtggatggta

SEQ ID NO: 587 - DNA, 20 bp, Artificial sequence
  Synthetic oligonucleotide
ttttagggaattgtcctgat

SEQ ID NO: 588 - DNA, 20 bp, Artificial sequence
  Synthetic oligonucleotide
aaggaaacacacataatacc

SEQ ID NO: 589 - DNA, 20 bp, Artificial sequence
  Synthetic oligonucleotide
ggaaggaaacacacataata

SEQ ID NO: 590 - DNA, 20 bp, Artificial sequence
  Synthetic oligonucleotide
cactaaggacaaagatatgg

SEQ ID NO: 591 - DNA, 20 bp, Artificial sequence
  Synthetic oligonucleotide
tatttgttcattctcaagaa

SEQ ID NO: 592 - DNA, 20 bp, Artificial sequence
  Synthetic oligonucleotide
caacctgggctctcatctaa

SEQ ID NO: 593 - DNA, 20 bp, Artificial sequence
  Synthetic oligonucleotide
aatgcttgatctgtgggctc

SEQ ID NO: 594 - DNA, 20 bp, Artificial sequence
  Synthetic oligonucleotide
attgtgtacacagggatttg

SEQ ID NO: 595 - DNA, 20 bp, Artificial sequence
  Synthetic oligonucleotide
aactgtatactttgaaagta

SEQ ID NO: 596 - DNA, 20 bp, Artificial sequence
  Synthetic oligonucleotide
gaagcaagtaagtaaataat

SEQ ID NO: 597 - DNA, 20 bp, Artificial sequence
  Synthetic oligonucleotide
cttagatgtgtttatccaaa

SEQ ID NO: 598 - DNA, 20 bp, Artificial sequence
  Synthetic oligonucleotide
gtgtttttccatttttctct

SEQ ID NO: 599 - DNA, 20 bp, Artificial sequence
  Synthetic oligonucleotide
tggctctatcaaggcttccc

SEQ ID NO: 600 - DNA, 20 bp, Artificial sequence
  Synthetic oligonucleotide
aatcctatattttggctcta

SEQ ID NO: 601 - DNA, 20 bp, Artificial sequence
  Synthetic oligonucleotide
gaactatcctgcatccgagg

SEQ ID NO: 602 - DNA, 20 bp, Artificial sequence
  Synthetic oligonucleotide
caaccatcgagatgatcata

SEQ ID NO: 603 - DNA, 20 bp, Artificial sequence
  Synthetic oligonucleotide
taaatgcttttctaaatcta

SEQ ID NO: 604 - DNA, 20 bp, Artificial sequence
  Synthetic oligonucleotide
gcttttatagtgttgaggca

SEQ ID NO: 605 - DNA, 20 bp, Artificial sequence
  Synthetic oligonucleotide
ttaagctctaattaaaacag

SEQ ID NO: 606 - DNA, 20 bp, Artificial sequence
  Synthetic oligonucleotide
tatttcactggagctttgat

SEQ ID NO: 607 - DNA, 20 bp, Artificial sequence
  Synthetic oligonucleotide
aatcatctactgatgaacac

SEQ ID NO: 608 - DNA, 20 bp, Artificial sequence
  Synthetic oligonucleotide
tctttatctaatcatctact

SEQ ID NO: 609 - DNA, 20 bp, Artificial sequence
  Synthetic oligonucleotide
ttctctttatctaatcatct

SEQ ID NO: 610 - DNA, 20 bp, Artificial sequence
  Synthetic oligonucleotide
agttcctggaaaccgccatt

SEQ ID NO: 611 - DNA, 20 bp, Artificial sequence
  Synthetic oligonucleotide
atgctgttgtacactagatc

SEQ ID NO: 612 - DNA, 20 bp, Artificial sequence
  Synthetic oligonucleotide
gtacactattgttttgatat

SEQ ID NO: 613 - DNA, 20 bp, Artificial sequence
  Synthetic oligonucleotide
cacccctaatttatattact

SEQ ID NO: 614 - DNA, 20 bp, Artificial sequence
  Synthetic oligonucleotide
cataggtcaattccttcacc

SEQ ID NO: 615 - DNA, 20 bp, Artificial sequence
  Synthetic oligonucleotide
ttaatttaaatagtttacaa

SEQ ID NO: 616 - DNA, 20 bp, Artificial sequence
  Synthetic oligonucleotide
ctagcttgaatggataccaa

SEQ ID NO: 617 - DNA, 20 bp, Artificial sequence
  Synthetic oligonucleotide
tagtggttgccttagtatta

SEQ ID NO: 618 - DNA, 20 bp, Artificial sequence
  Synthetic oligonucleotide
caagtgctatatttttttaa

SEQ ID NO: 619 - DNA, 20 bp, Artificial sequence
  Synthetic oligonucleotide
tatatataattgagggccac

SEQ ID NO: 620 - DNA, 20 bp, Artificial sequence
  Synthetic oligonucleotide
ataattataagatagggttt

SEQ ID NO: 621 - DNA, 20 bp, Artificial sequence
  Synthetic oligonucleotide
attagtattgctgctctagc

SEQ ID NO: 622 - DNA, 20 bp, Artificial sequence
  Synthetic oligonucleotide
ccaactgtaatcattgattt

SEQ ID NO: 623 - DNA, 20 bp, Artificial sequence
  Synthetic oligonucleotide
gataatgtgtagttttttat

SEQ ID NO: 624 - DNA, 20 bp, Artificial sequence
  Synthetic oligonucleotide
taaggtgttgtatgataatg

SEQ ID NO: 625 - DNA, 20 bp, Artificial sequence
  Synthetic oligonucleotide
aatatgtgtcatcctgaaga

SEQ ID NO: 626 - DNA, 20 bp, Artificial sequence
  Synthetic oligonucleotide
tcattgtgaatttcccacat

SEQ ID NO: 627 - DNA, 20 bp, Artificial sequence
  Synthetic oligonucleotide
ttagggatatactgttatac

SEQ ID NO: 628 - DNA, 20 bp, Artificial sequence
  Synthetic oligonucleotide
aaaattaggttattggattg

SEQ ID NO: 629 - DNA, 20 bp, Artificial sequence
  Synthetic oligonucleotide
ctttcactctcatttcttaa

SEQ ID NO: 630 - DNA, 20 bp, Artificial sequence
  Synthetic oligonucleotide
actttcaagtttattaattt

SEQ ID NO: 631 - DNA, 20 bp, Artificial sequence
  Synthetic oligonucleotide
tactttcatttatgtctagt

SEQ ID NO: 632 - DNA, 20 bp, Artificial sequence
  Synthetic oligonucleotide
gatatctatactttcattta

SEQ ID NO: 633 - DNA, 20 bp, Artificial sequence
  Synthetic oligonucleotide
catgtttttacaccagctgt

SEQ ID NO: 634 - DNA, 20 bp, Artificial sequence
  Synthetic oligonucleotide
ttacttactcaatttcttct

SEQ ID NO: 635 - DNA, 20 bp, Artificial sequence
  Synthetic oligonucleotide
gtttcagcagtttctgctcc

SEQ ID NO: 636 - DNA, 20 bp, Artificial sequence
  Synthetic oligonucleotide
gggcacttaggagttcctaa

SEQ ID NO: 637 - DNA, 20 bp, Artificial sequence
  Synthetic oligonucleotide
ctctgagagtgtttagaaat

SEQ ID NO: 638 - DNA, 20 bp, Artificial sequence
  Synthetic oligonucleotide
gtgaaagaaaatgctctgag

SEQ ID NO: 639 - DNA, 20 bp, Artificial sequence
  Synthetic oligonucleotide
tacatcagacaaggctcagg

SEQ ID NO: 640 - DNA, 20 bp, Artificial sequence
  Synthetic oligonucleotide
ttctataatcttatggttaa

SEQ ID NO: 641 - DNA, 20 bp, Artificial sequence
  Synthetic oligonucleotide
gaagtgttctataatcttat

SEQ ID NO: 642 - DNA, 20 bp, Artificial sequence
  Synthetic oligonucleotide
gtgaaaattttgtaggttgc

SEQ ID NO: 643 - DNA, 20 bp, Artificial sequence
  Synthetic oligonucleotide
tacaatcagtgtctttcacc

SEQ ID NO: 644 - DNA, 20 bp, Artificial sequence
  Synthetic oligonucleotide
atggttagggctatgttatg

SEQ ID NO: 645 - DNA, 20 bp, Artificial sequence
  Synthetic oligonucleotide
gaaataaaacgcaatgtatc

SEQ ID NO: 646 - DNA, 20 bp, Artificial sequence
  Synthetic oligonucleotide
cttgcatgttgcctttttct

SEQ ID NO: 647 - DNA, 20 bp, Artificial sequence
  Synthetic oligonucleotide
aactctctgccattattact

SEQ ID NO: 648 - DNA, 20 bp, Artificial sequence
  Synthetic oligonucleotide
taatctcactggatacagaa

SEQ ID NO: 649 - DNA, 20 bp, Artificial sequence
  Synthetic oligonucleotide
aaacattttaccattttata

SEQ ID NO: 650 - DNA, 20 bp, Artificial sequence
  Synthetic oligonucleotide
gttattctccctcttgaacc

SEQ ID NO: 651 - DNA, 20 bp, Artificial sequence
  Synthetic oligonucleotide
tctgttattctccctcttga

SEQ ID NO: 652 - DNA, 20 bp, Artificial sequence
  Synthetic oligonucleotide
ggtctgttattctccctctt

SEQ ID NO: 653 - DNA, 20 bp, Artificial sequence
  Synthetic oligonucleotide
taaggtctgttattctccct

SEQ ID NO: 654 - DNA, 20 bp, Artificial sequence
  Synthetic oligonucleotide
aaagtaaggtctgttattct

SEQ ID NO: 655 - DNA, 20 bp, Artificial sequence
  Synthetic oligonucleotide
ctaaaagtaaggtctgttat

SEQ ID NO: 656 - DNA, 20 bp, Artificial sequence
  Synthetic oligonucleotide
gactaaaagtaaggtctgtt

SEQ ID NO: 657 - DNA, 20 bp, Artificial sequence
  Synthetic oligonucleotide
aatgactaaaagtaaggtct

SEQ ID NO: 658 - DNA, 20 bp, Artificial sequence
  Synthetic oligonucleotide
aaagatatagaactgaaaag

SEQ ID NO: 659 - DNA, 20 bp, Artificial sequence
  Synthetic oligonucleotide
gttggagacttcaatttcct

SEQ ID NO: 660 - DNA, 20 bp, Artificial sequence
  Synthetic oligonucleotide
aaacaacagagcctcaaata

SEQ ID NO: 661 - DNA, 20 bp, Artificial sequence
  Synthetic oligonucleotide
aaaataccacaaagataggc

SEQ ID NO: 662 - DNA, 20 bp, Artificial sequence
  Synthetic oligonucleotide
aagaatggaaaagatgtatc

SEQ ID NO: 663 - DNA, 20 bp, Artificial sequence
  Synthetic oligonucleotide
taaaagaatggaaaagatgt

SEQ ID NO: 664 - DNA, 20 bp, Artificial sequence
  Synthetic oligonucleotide
aattttacctcagtataaaa

SEQ ID NO: 665 - DNA, 20 bp, Artificial sequence
  Synthetic oligonucleotide
attaccaaatgccactgtat

SEQ ID NO: 666 - DNA, 20 bp, Artificial sequence
  Synthetic oligonucleotide
gttgcataacatgtgtatta

SEQ ID NO: 667 - DNA, 20 bp, Artificial sequence
  Synthetic oligonucleotide
aattaactgcttaatgagta

SEQ ID NO: 668 - DNA, 20 bp, Artificial sequence
  Synthetic oligonucleotide
ataaaggtcacttattgtat

SEQ ID NO: 669 - DNA, 20 bp, Artificial sequence
  Synthetic oligonucleotide
aataaaactgatacatacta

SEQ ID NO: 670 - DNA, 20 bp, Artificial sequence
  Synthetic oligonucleotide
aatcaacttttagctataca

SEQ ID NO: 671 - DNA, 20 bp, Artificial sequence
  Synthetic oligonucleotide
tatcattatgacctaggaat

SEQ ID NO: 672 - DNA, 20 bp, Artificial sequence
  Synthetic oligonucleotide
actggaattactaaaaggga

SEQ ID NO: 673 - DNA, 20 bp, Artificial sequence
  Synthetic oligonucleotide
agtagagagtgggatggtat

SEQ ID NO: 674 - DNA, 20 bp, Artificial sequence
  Synthetic oligonucleotide
taagaaacatcacattcaag

SEQ ID NO: 675 - DNA, 20 bp, Artificial sequence
  Synthetic oligonucleotide
tgaacagaatgagaagttta

SEQ ID NO: 676 - DNA, 20 bp, Artificial sequence
  Synthetic oligonucleotide
tctgaacagaatgagaagtt

SEQ ID NO: 677 - DNA, 20 bp, Artificial sequence
  Synthetic oligonucleotide
tggtgtacattggatatgaa

SEQ ID NO: 678 - DNA, 20 bp, Artificial sequence
  Synthetic oligonucleotide
tttctaacatttactgtgga

SEQ ID NO: 679 - DNA, 20 bp, Artificial sequence
  Synthetic oligonucleotide
ttctaacatactaattagca

SEQ ID NO: 680 - DNA, 20 bp, Artificial sequence
  Synthetic oligonucleotide
caccaatgcaagccagcttc

SEQ ID NO: 681 - DNA, 20 bp, Artificial sequence
  Synthetic oligonucleotide
tgtttagaggtcaagccctg

SEQ ID NO: 682 - DNA, 20 bp, Artificial sequence
  Synthetic oligonucleotide
atcagtcaaaacatgttctg

SEQ ID NO: 683 - DNA, 20 bp, Artificial sequence
  Synthetic oligonucleotide
tattacacaaggtattggta

SEQ ID NO: 684 - DNA, 20 bp, Artificial sequence
  Synthetic oligonucleotide
atgaaaggtttattacacaa

SEQ ID NO: 685 - DNA, 20 bp, Artificial sequence
  Synthetic oligonucleotide
aatcaatttgtgccacaggc

SEQ ID NO: 686 - DNA, 20 bp, Artificial sequence
  Synthetic oligonucleotide
gcagcttataaagagagcca

SEQ ID NO: 687 - DNA, 20 bp, Artificial sequence
  Synthetic oligonucleotide
tttggtaggtaactacgggt

SEQ ID NO: 688 - DNA, 20 bp, Artificial sequence
  Synthetic oligonucleotide
tcggatatagcttttacata

SEQ ID NO: 689 - DNA, 20 bp, Artificial sequence
  Synthetic oligonucleotide
aaactaagcacatccgatag

SEQ ID NO: 690 - DNA, 20 bp, Artificial sequence
  Synthetic oligonucleotide
atcatctttgatttgacttt

SEQ ID NO: 691 - DNA, 20 bp, Artificial sequence
  Synthetic oligonucleotide
ttctttatgaatctttgaaa

SEQ ID NO: 692 - DNA, 20 bp, Artificial sequence
  Synthetic oligonucleotide
gtaaagagccacctaaggga

SEQ ID NO: 693 - DNA, 20 bp, Artificial sequence
  Synthetic oligonucleotide
atgagatgggcacagtaaag

SEQ ID NO: 694 - DNA, 20 bp, Artificial sequence
  Synthetic oligonucleotide
tccccagataatgcatagat

SEQ ID NO: 695 - DNA, 20 bp, Artificial sequence
  Synthetic oligonucleotide
ggtggcatagaaggcagcac

SEQ ID NO: 696 - DNA, 20 bp, Artificial sequence
  Synthetic oligonucleotide
ggatgcagcaggagaagaaa

SEQ ID NO: 697 - DNA, 20 bp, Artificial sequence
  Synthetic oligonucleotide
aaggcaaggctaaggagtgc

SEQ ID NO: 698 - DNA, 20 bp, Artificial sequence
  Synthetic oligonucleotide
agagagctagagctaggact

SEQ ID NO: 699 - DNA, 20 bp, Artificial sequence
  Synthetic oligonucleotide
atcccaaagttacacagaga

SEQ ID NO: 700 - DNA, 20 bp, Artificial sequence
  Synthetic oligonucleotide
cacctgtatccaaaattcaa

SEQ ID NO: 701 - DNA, 20 bp, Artificial sequence
  Synthetic oligonucleotide
catatctgaagcacagagag

SEQ ID NO: 702 - DNA, 20 bp, Artificial sequence
  Synthetic oligonucleotide
cagtctgctctgctgctctg

SEQ ID NO: 703 - DNA, 20 bp, Artificial sequence
  Synthetic oligonucleotide
tccagtctgctctgctgctc

SEQ ID NO: 704 - DNA, 20 bp, Artificial sequence
  Synthetic oligonucleotide
agctcagaggcagcaggagc

SEQ ID NO: 705 - DNA, 20 bp, Artificial sequence
  Synthetic oligonucleotide
ctaagctccatatttaaatc

SEQ ID NO: 706 - DNA, 20 bp, Artificial sequence
  Synthetic oligonucleotide
ttcaggcttccttcacagcc

SEQ ID NO: 707 - DNA, 20 bp, Artificial sequence
  Synthetic oligonucleotide
ttcttcaggcttccttcaca

SEQ ID NO: 708 - DNA, 20 bp, Artificial sequence
  Synthetic oligonucleotide
ggaatcagtgctacccatta

SEQ ID NO: 709 - DNA, 20 bp, Artificial sequence
  Synthetic oligonucleotide
ttagccatcattttattctc

SEQ ID NO: 710 - DNA, 20 bp, Artificial sequence
  Synthetic oligonucleotide
ggcccattttttcaatctca

SEQ ID NO: 711 - DNA, 20 bp, Artificial sequence
  Synthetic oligonucleotide
catggtcttccttgactaca

SEQ ID NO: 712 - DNA, 20 bp, Artificial sequence
  Synthetic oligonucleotide
aagccaatgcgcaagaaaag

SEQ ID NO: 713 - DNA, 20 bp, Artificial sequence
  Synthetic oligonucleotide
catccagttaatctctgaca

SEQ ID NO: 714 - DNA, 20 bp, Artificial sequence
  Synthetic oligonucleotide
ctcgcatccagttaatctct

SEQ ID NO: 715 - DNA, 20 bp, Artificial sequence
  Synthetic oligonucleotide
acaccatcccagaaatggtc

SEQ ID NO: 716 - DNA, 20 bp, Artificial sequence
  Synthetic oligonucleotide
tttctgactccctatccagt

SEQ ID NO: 717 - DNA, 20 bp, Artificial sequence
  Synthetic oligonucleotide
ttccccagggtcataggagt

SEQ ID NO: 718 - DNA, 20 bp, Artificial sequence
  Synthetic oligonucleotide
gcactgtcccagttggatta

SEQ ID NO: 719 - DNA, 20 bp, Artificial sequence
  Synthetic oligonucleotide
acccagcaaaatgtgggtct

SEQ ID NO: 720 - DNA, 20 bp, Artificial sequence
  Synthetic oligonucleotide
ttggttgtggtgaaacccag

SEQ ID NO: 721 - DNA, 20 bp, Artificial sequence
  Synthetic oligonucleotide
tgttaaaagagaaaagaatc

SEQ ID NO: 722 - DNA, 20 bp, Artificial sequence
  Synthetic oligonucleotide
ttgcagtgatgtactgatgt

SEQ ID NO: 723 - DNA, 20 bp, Artificial sequence
  Synthetic oligonucleotide
ttgtttttataagcaattag

SEQ ID NO: 724 - DNA, 20 bp, Artificial sequence
  Synthetic oligonucleotide
tataaatatgcccatatgct

SEQ ID NO: 725 - DNA, 20 bp, Artificial sequence
  Synthetic oligonucleotide
ctgcctgcaactataaatat

SEQ ID NO: 726 - DNA, 20 bp, Artificial sequence
  Synthetic oligonucleotide
gtatctcctagcccagtgcc

SEQ ID NO: 727 - DNA, 20 bp, Artificial sequence
  Synthetic oligonucleotide
actgtatctcctagcccagt

SEQ ID NO: 728 - DNA, 20 bp, Artificial sequence
  Synthetic oligonucleotide
gattgctttattgcaactaa

SEQ ID NO: 729 - DNA, 20 bp, Artificial sequence
  Synthetic oligonucleotide
cttaaatagtaggaaagcca

SEQ ID NO: 730 - DNA, 20 bp, Artificial sequence
  Synthetic oligonucleotide
gcacactgtacaggagggtg

SEQ ID NO: 731 - DNA, 20 bp, Artificial sequence
  Synthetic oligonucleotide
cactgcacactgtacaggag

SEQ ID NO: 732 - DNA, 20 bp, Artificial sequence
  Synthetic oligonucleotide
gattcactgcacactgtaca

SEQ ID NO: 733 - DNA, 20 bp, Artificial sequence
  Synthetic oligonucleotide
tgttgattcactgcacactg

SEQ ID NO: 734 - DNA, 20 bp, Artificial sequence
  Synthetic oligonucleotide
atgatgttgattcactgcac

SEQ ID NO: 735 - DNA, 20 bp, Artificial sequence
  Synthetic oligonucleotide
ggaaatgatgttgattcact

SEQ ID NO: 736 - DNA, 20 bp, Artificial sequence
  Synthetic oligonucleotide
tgtggaaatgatgttgattc

SEQ ID NO: 737 - DNA, 20 bp, Artificial sequence
  Synthetic oligonucleotide
cagtatcttaactggtgaac

SEQ ID NO: 738 - DNA, 20 bp, Artificial sequence
  Synthetic oligonucleotide
acatagaattatcattatga

SEQ ID NO: 739 - DNA, 20 bp, Artificial sequence
  Synthetic oligonucleotide
atgggttaaaatacttataa

SEQ ID NO: 740 - DNA, 20 bp, Artificial sequence
  Synthetic oligonucleotide
taaaacctttgtgcataatg

SEQ ID NO: 741 - DNA, 20 bp, Artificial sequence
  Synthetic oligonucleotide
caacaacaaaagcggataaa

SEQ ID NO: 742 - DNA, 20 bp, Artificial sequence
  Synthetic oligonucleotide
atgacactaggttttgcaaa

SEQ ID NO: 743 - DNA, 20 bp, Artificial sequence
  Synthetic oligonucleotide
acctcatgacactaggtttt

SEQ ID NO: 744 - DNA, 20 bp, Artificial sequence
  Synthetic oligonucleotide
gtatagacccaaactataaa

SEQ ID NO: 745 - DNA, 20 bp, Artificial sequence
  Synthetic oligonucleotide
atgtatagacccaaactata

SEQ ID NO: 746 - DNA, 20 bp, Artificial sequence
  Synthetic oligonucleotide
tgatctcttcaacaaattgt

SEQ ID NO: 747 - DNA, 20 bp, Artificial sequence
  Synthetic oligonucleotide
aatgttgccgaaagaaaaga

SEQ ID NO: 748 - DNA, 20 bp, Artificial sequence
  Synthetic oligonucleotide
acaagtgtcatatactaaat

SEQ ID NO: 749 - DNA, 20 bp, Artificial sequence
  Synthetic oligonucleotide
aaatttaaccaaggagttac

SEQ ID NO: 750 - DNA, 20 bp, Artificial sequence
  Synthetic oligonucleotide
agccatctaaaagagaaatt

SEQ ID NO: 751 - DNA, 20 bp, Artificial sequence
  Synthetic oligonucleotide
gatcaagaagtaaaattatc

SEQ ID NO: 752 - DNA, 20 bp, Artificial sequence
  Synthetic oligonucleotide
cacatgataatctcaattat

SEQ ID NO: 753 - DNA, 20 bp, Artificial sequence
  Synthetic oligonucleotide
gaaaaattcactctataggt

SEQ ID NO: 754 - DNA, 20 bp, Artificial sequence
  Synthetic oligonucleotide
ctatagagagatagatatta

SEQ ID NO: 755 - DNA, 20 bp, Artificial sequence
  Synthetic oligonucleotide
agaaaaatgtctttccaaat

SEQ ID NO: 756 - DNA, 20 bp, Artificial sequence
  Synthetic oligonucleotide
caaatacttaaatcaactgt

SEQ ID NO: 757 - DNA, 20 bp, Artificial sequence
  Synthetic oligonucleotide
ggagggaggaaaattatttc

SEQ ID NO: 758 - DNA, 20 bp, Artificial sequence
  Synthetic oligonucleotide
agcaaacaacagcaacatgc

SEQ ID NO: 759 - DNA, 20 bp, Artificial sequence
  Synthetic oligonucleotide
aaaatactttagaaaagtca

SEQ ID NO: 760 - DNA, 20 bp, Artificial sequence
  Synthetic oligonucleotide
cagaattcaatggacccaca

SEQ ID NO: 761 - DNA, 20 bp, Artificial sequence
  Synthetic oligonucleotide
tcggcaaaggcattattatt

SEQ ID NO: 762 - DNA, 20 bp, Artificial sequence
  Synthetic oligonucleotide
gctttcacctataggtggcc

SEQ ID NO: 763 - DNA, 20 bp, Artificial sequence
  Synthetic oligonucleotide
gatgttaagctttcacctat

SEQ ID NO: 764 - DNA, 20 bp, Artificial sequence
  Synthetic oligonucleotide
tacccagggtaggattcatg

SEQ ID NO: 765 - DNA, 20 bp, Artificial sequence
  Synthetic oligonucleotide
gcatacccagggtaggattc

SEQ ID NO: 766 - DNA, 20 bp, Artificial sequence
  Synthetic oligonucleotide
gtgcatacccagggtaggat

SEQ ID NO: 767 - DNA, 20 bp, Artificial sequence
  Synthetic oligonucleotide
catgtgcatacccagggtag

SEQ ID NO: 768 - DNA, 20 bp, Artificial sequence
  Synthetic oligonucleotide
agatcatgtgcatacccagg

SEQ ID NO: 769 - DNA, 20 bp, Artificial sequence
  Synthetic oligonucleotide
agaagatcatgtgcataccc

SEQ ID NO: 770 - DNA, 20 bp, Artificial sequence
  Synthetic oligonucleotide
taagaagatcatgtgcatac

SEQ ID NO: 771 - DNA, 20 bp, Artificial sequence
  Synthetic oligonucleotide
aattaagaagatcatgtgca

SEQ ID NO: 772 - DNA, 20 bp, Artificial sequence
  Synthetic oligonucleotide
gttcagatgaacaataagca

SEQ ID NO: 773 - DNA, 20 bp, Artificial sequence
  Synthetic oligonucleotide
actcatgctggttactaggg

SEQ ID NO: 774 - DNA, 20 bp, Artificial sequence
  Synthetic oligonucleotide
tcatatgggtggtcgctaat

SEQ ID NO: 775 - DNA, 20 bp, Artificial sequence
  Synthetic oligonucleotide
acactaacgatgaactctaa

SEQ ID NO: 776 - DNA, 20 bp, Artificial sequence
  Synthetic oligonucleotide
taacactaacgatgaactct

SEQ ID NO: 777 - DNA, 20 bp, Artificial sequence
  Synthetic oligonucleotide
ttaaaactcaacccagtgca

SEQ ID NO: 778 - DNA, 20 bp, Artificial sequence
  Synthetic oligonucleotide
attcctagagaaaacctagg

SEQ ID NO: 779 - DNA, 20 bp, Artificial sequence
  Synthetic oligonucleotide
agaacaatgtttcttatgaa

SEQ ID NO: 780 - DNA, 20 bp, Artificial sequence
  Synthetic oligonucleotide
gaaactgggatattaccaat

SEQ ID NO: 781 - DNA, 20 bp, Artificial sequence
  Synthetic oligonucleotide
aaaatggaaactgggatatt

SEQ ID NO: 782 - DNA, 20 bp, Artificial sequence
  Synthetic oligonucleotide
aaaaattaaaggccaacaga

SEQ ID NO: 783 - DNA, 20 bp, Artificial sequence
  Synthetic oligonucleotide
ttatggcaggtagtgaaagg

SEQ ID NO: 784 - DNA, 20 bp, Artificial sequence
  Synthetic oligonucleotide
acaatatgcaaaaattaaat

SEQ ID NO: 785 - DNA, 20 bp, Artificial sequence
  Synthetic oligonucleotide
cattctccaacatagatcct

SEQ ID NO: 786 - DNA, 20 bp, Artificial sequence
  Synthetic oligonucleotide
caataatagagactttacca

SEQ ID NO: 787 - DNA, 20 bp, Artificial sequence
  Synthetic oligonucleotide
atatattatgtaaatgtaac

SEQ ID NO: 788 - DNA, 20 bp, Artificial sequence
  Synthetic oligonucleotide
aggatggaaaagatatatta

SEQ ID NO: 789 - DNA, 20 bp, Artificial sequence
  Synthetic oligonucleotide
aaacaggttgaaaatgaaag

SEQ ID NO: 790 - DNA, 20 bp, Artificial sequence
  Synthetic oligonucleotide
aaaggcaatattgaaggaaa

SEQ ID NO: 791 - DNA, 20 bp, Artificial sequence
  Synthetic oligonucleotide
gaattgagttaataattcct

SEQ ID NO: 792 - DNA, 20 bp, Artificial sequence
  Synthetic oligonucleotide
tctcacagagaaagaggtgg

SEQ ID NO: 793 - DNA, 20 bp, Artificial sequence
  Synthetic oligonucleotide
ttttctataatctcacagag

SEQ ID NO: 794 - DNA, 20 bp, Artificial sequence
  Synthetic oligonucleotide
ggctcagaaaacatcctttt

SEQ ID NO: 795 - DNA, 20 bp, Artificial sequence
  Synthetic oligonucleotide
atttaatttacacttaatta

SEQ ID NO: 796 - DNA, 20 bp, Artificial sequence
  Synthetic oligonucleotide
actttcctctgcttataact

SEQ ID NO: 797 - DNA, 20 bp, Artificial sequence
  Synthetic oligonucleotide
actatactttcctctgctta

SEQ ID NO: 798 - DNA, 20 bp, Artificial sequence
  Synthetic oligonucleotide
agcaattagaaatcacatga

SEQ ID NO: 799 - DNA, 20 bp, Artificial sequence
  Synthetic oligonucleotide
aaagcagtaaacaataagtg

SEQ ID NO: 800 - DNA, 20 bp, Artificial sequence
  Synthetic oligonucleotide
tcatatgtaaatccaaaagc

SEQ ID NO: 801 - DNA, 20 bp, Artificial sequence
  Synthetic oligonucleotide
cattgtaaggataagagata

SEQ ID NO: 802 - DNA, 20 bp, Artificial sequence
  Synthetic oligonucleotide
cagtttgaattacattgtaa

SEQ ID NO: 803 - DNA, 20 bp, Artificial sequence
  Synthetic oligonucleotide
aattgaacttaaattggcat

SEQ ID NO: 804 - DNA, 20 bp, Artificial sequence
  Synthetic oligonucleotide
ctgcataggagtagagtttt

SEQ ID NO: 805 - DNA, 20 bp, Artificial sequence
  Synthetic oligonucleotide
aagatggaatttgcgacatc

SEQ ID NO: 806 - DNA, 20 bp, Artificial sequence
  Synthetic oligonucleotide
acataaaaatgtataaatcc

SEQ ID NO: 807 - DNA, 20 bp, Artificial sequence
  Synthetic oligonucleotide
actgataaaggtaagcacat

SEQ ID NO: 808 - DNA, 20 bp, Artificial sequence
  Synthetic oligonucleotide
cagagaggagagaaggacaa

SEQ ID NO: 809 - DNA, 20 bp, Artificial sequence
  Synthetic oligonucleotide
ggctaggaaaattctcctgg

SEQ ID NO: 810 - DNA, 20 bp, Artificial sequence
  Synthetic oligonucleotide
agggagagctgtcctaaggc

SEQ ID NO: 811 - DNA, 20 bp, Artificial sequence
  Synthetic oligonucleotide
gatatccagggagagctgtc

SEQ ID NO: 812 - DNA, 20 bp, Artificial sequence
  Synthetic oligonucleotide
ttgaagggaaaattattaat

SEQ ID NO: 813 - DNA, 20 bp, Artificial sequence
  Synthetic oligonucleotide
agctggacggacagtgttgc

SEQ ID NO: 814 - DNA, 20 bp, Artificial sequence
  Synthetic oligonucleotide
caagacatgctagggactct

SEQ ID NO: 815 - DNA, 20 bp, Artificial sequence
  Synthetic oligonucleotide
ccaagacatgctagggactc

SEQ ID NO: 816 - DNA, 20 bp, Artificial sequence
  Synthetic oligonucleotide
gccacagtccaagacatgct

SEQ ID NO: 817 - DNA, 20 bp, Artificial sequence
  Synthetic oligonucleotide
gcagataatctgaagataga

SEQ ID NO: 818 - DNA, 20 bp, Artificial sequence
  Synthetic oligonucleotide
tttattacaaactgaaagag

SEQ ID NO: 819 - DNA, 20 bp, Artificial sequence
  Synthetic oligonucleotide
ggtcagataatgagggcctt

SEQ ID NO: 820 - DNA, 20 bp, Artificial sequence
  Synthetic oligonucleotide
aggataggtgtatgtgagtg

SEQ ID NO: 821 - DNA, 20 bp, Artificial sequence
  Synthetic oligonucleotide
atgaaggtcaagccgaatct

SEQ ID NO: 822 - DNA, 20 bp, Artificial sequence
  Synthetic oligonucleotide
aaaagaagtatgtgaaagta

SEQ ID NO: 823 - DNA, 20 bp, Artificial sequence
  Synthetic oligonucleotide
tgtctctaatcctattccaa

SEQ ID NO: 824 - DNA, 20 bp, Artificial sequence
  Synthetic oligonucleotide
agtcttcatgatttggtaaa

SEQ ID NO: 825 - DNA, 20 bp, Artificial sequence
  Synthetic oligonucleotide
agtaagaggcagaattatgt

SEQ ID NO: 826 - DNA, 20 bp, Artificial sequence
  Synthetic oligonucleotide
gggcagcaacagctcttgaa

SEQ ID NO: 827 - DNA, 20 bp, Artificial sequence
  Synthetic oligonucleotide
taataattaacagtgactgg

SEQ ID NO: 828 - DNA, 20 bp, Artificial sequence
  Synthetic oligonucleotide
aagtcattccccaccctggc

SEQ ID NO: 829 - DNA, 20 bp, Artificial sequence
  Synthetic oligonucleotide
tccagcagggtgtattccag

SEQ ID NO: 830 - DNA, 20 bp, Artificial sequence
  Synthetic oligonucleotide
tcagctgtggtttccagcag

SEQ ID NO: 831 - DNA, 20 bp, Artificial sequence
  Synthetic oligonucleotide
gcttagagaatctcagctgt

SEQ ID NO: 832 - DNA, 20 bp, Artificial sequence
  Synthetic oligonucleotide
ggttggaagctgccagctta

SEQ ID NO: 833 - DNA, 20 bp, Artificial sequence
  Synthetic oligonucleotide
aatggactgccggcctggag

SEQ ID NO: 834 - DNA, 20 bp, Artificial sequence
  Synthetic oligonucleotide
tgaactacttggagaccttc

SEQ ID NO: 835 - DNA, 20 bp, Artificial sequence
  Synthetic oligonucleotide
agtgaactacttggagacct

SEQ ID NO: 836 - DNA, 20 bp, Artificial sequence
  Synthetic oligonucleotide
tcttttattaaacctagttt

SEQ ID NO: 837 - DNA, 20 bp, Artificial sequence
  Synthetic oligonucleotide
ttagctagctgtgggtttgc

SEQ ID NO: 838 - DNA, 20 bp, Artificial sequence
  Synthetic oligonucleotide
acaagagcagacatcttttt

SEQ ID NO: 839 - DNA, 20 bp, Artificial sequence
  Synthetic oligonucleotide
tgtagcttttctaaaattct

SEQ ID NO: 840 - DNA, 20 bp, Artificial sequence
  Synthetic oligonucleotide
gtatattgtagcttttctaa

SEQ ID NO: 841 - DNA, 20 bp, Artificial sequence
  Synthetic oligonucleotide
cttgatggctgtagcttggt

SEQ ID NO: 842 - DNA, 20 bp, Artificial sequence
  Synthetic oligonucleotide
tttctggattctcagtctta

SEQ ID NO: 843 - DNA, 20 bp, Artificial sequence
  Synthetic oligonucleotide
tgcattggtatctgtatatc

SEQ ID NO: 844 - DNA, 20 bp, Artificial sequence
  Synthetic oligonucleotide
gtttcctatttcatccattt

SEQ ID NO: 845 - DNA, 20 bp, Artificial sequence
  Synthetic oligonucleotide
ctggagtgtaagtaaattca

SEQ ID NO: 846 - DNA, 20 bp, Artificial sequence
  Synthetic oligonucleotide
atactctttccacatttcag

SEQ ID NO: 847 - DNA, 20 bp, Artificial sequence
  Synthetic oligonucleotide
tcctcttgatactctttcca

SEQ ID NO: 848 - DNA, 20 bp, Artificial sequence
  Synthetic oligonucleotide
cttagggtctcctcttgata

SEQ ID NO: 849 - DNA, 20 bp, Artificial sequence
  Synthetic oligonucleotide
cagagtgtcttagggtctcc

SEQ ID NO: 850 - DNA, 20 bp, Artificial sequence
  Synthetic oligonucleotide
atatttctcaaatactcttc

SEQ ID NO: 851 - DNA, 20 bp, Artificial sequence
  Synthetic oligonucleotide
tgtgctagaacactatcttg

SEQ ID NO: 852 - DNA, 20 bp, Artificial sequence
  Synthetic oligonucleotide
tgactctcatctccctcttc

SEQ ID NO: 853 - DNA, 20 bp, Artificial sequence
  Synthetic oligonucleotide
ccctgactctcatctccctc

SEQ ID NO: 854 - DNA, 20 bp, Artificial sequence
  Synthetic oligonucleotide
ccttccttctttatactgcc

SEQ ID NO: 855 - DNA, 20 bp, Artificial sequence
  Synthetic oligonucleotide
catcaaaatctctcattcct

SEQ ID NO: 856 - DNA, 20 bp, Artificial sequence
  Synthetic oligonucleotide
aatcatcaaaatctctcatt

SEQ ID NO: 857 - DNA, 20 bp, Artificial sequence
  Synthetic oligonucleotide
ccccaatcatcaaaatctct

SEQ ID NO: 858 - DNA, 20 bp, Artificial sequence
  Synthetic oligonucleotide
tagtcagtagtcctaaaaac

SEQ ID NO: 859 - DNA, 20 bp, Artificial sequence
  Synthetic oligonucleotide
agacctctgtctctgggatt

SEQ ID NO: 860 - DNA, 20 bp, Artificial sequence
  Synthetic oligonucleotide
aaagtccttacctgttcttg

SEQ ID NO: 861 - DNA, 20 bp, Artificial sequence
  Synthetic oligonucleotide
ttcaccgaaagtacagtctt

SEQ ID NO: 862 - DNA, 20 bp, Artificial sequence
  Synthetic oligonucleotide
tagtttcaccgaaagtacag

SEQ ID NO: 863 - DNA, 20 bp, Artificial sequence
  Synthetic oligonucleotide
aagtcttttctcccctcccc

SEQ ID NO: 864 - DNA, 20 bp, Artificial sequence
  Synthetic oligonucleotide
tcaacagtgttagtgtgtaa

SEQ ID NO: 865 - DNA, 20 bp, Artificial sequence
  Synthetic oligonucleotide
ccttttacctcaacagtgtt

SEQ ID NO: 866 - DNA, 20 bp, Artificial sequence
  Synthetic oligonucleotide
agactagtccctgtgtagtc

SEQ ID NO: 867 - DNA, 20 bp, Artificial sequence
  Synthetic oligonucleotide
ccaagactagtccctgtgta

SEQ ID NO: 868 - DNA, 20 bp, Artificial sequence
  Synthetic oligonucleotide
aactgtcagaggaagaaatg

SEQ ID NO: 869 - DNA, 20 bp, Artificial sequence
  Synthetic oligonucleotide
cgaacagaacttgccgatgt

SEQ ID NO: 870 - DNA, 20 bp, Artificial sequence
  Synthetic oligonucleotide
ttgtatagggagatgataga

SEQ ID NO: 871 - DNA, 20 bp, Artificial sequence
  Synthetic oligonucleotide
taaccttttattattataga

SEQ ID NO: 872 - DNA, 20 bp, Artificial sequence
  Synthetic oligonucleotide
taaactaaagtaactggttt

SEQ ID NO: 873 - DNA, 20 bp, Artificial sequence
  Synthetic oligonucleotide
ccaggaagctctggagggaa

SEQ ID NO: 874 - DNA, 20 bp, Artificial sequence
  Synthetic oligonucleotide
actctattatatattttggt

SEQ ID NO: 875 - DNA, 20 bp, Artificial sequence
  Synthetic oligonucleotide
gttataaaagtacttttttt

SEQ ID NO: 876 - DNA, 20 bp, Artificial sequence
  Synthetic oligonucleotide
ggatacttcctctaccccaa

SEQ ID NO: 877 - DNA, 20 bp, Artificial sequence
  Synthetic oligonucleotide
acagtggatacttcctctac

SEQ ID NO: 878 - DNA, 20 bp, Artificial sequence
  Synthetic oligonucleotide
ctgccttttcattactattt

SEQ ID NO: 879 - DNA, 20 bp, Artificial sequence
  Synthetic oligonucleotide
gttttaaagtggtaattgaa

SEQ ID NO: 880 - DNA, 20 bp, Artificial sequence
  Synthetic oligonucleotide
tcatcatcaacctaaccgag

SEQ ID NO: 881 - DNA, 20 bp, Artificial sequence
  Synthetic oligonucleotide
ccatcttggaaccggatgac

SEQ ID NO: 882 - DNA, 20 bp, Artificial sequence
  Synthetic oligonucleotide
gtaattgaggtggccatatc

SEQ ID NO: 883 - DNA, 20 bp, Artificial sequence
  Synthetic oligonucleotide
gagtcctaaatgtctcatac

SEQ ID NO: 884 - DNA, 20 bp, Artificial sequence
  Synthetic oligonucleotide
ggttttagtccactggttca

SEQ ID NO: 885 - DNA, 20 bp, Artificial sequence
  Synthetic oligonucleotide
ctagtcatgtatctacagcc

SEQ ID NO: 886 - DNA, 20 bp, Artificial sequence
  Synthetic oligonucleotide
gtatatggcttacacaggct

SEQ ID NO: 887 - DNA, 20 bp, Artificial sequence
  Synthetic oligonucleotide
gagatttcagactacctgta

SEQ ID NO: 888 - DNA, 20 bp, Artificial sequence
  Synthetic oligonucleotide
attgacccagcccatggcac

SEQ ID NO: 889 - DNA, 20 bp, Artificial sequence
  Synthetic oligonucleotide
gcgcattgagcaaaattcca

SEQ ID NO: 890 - DNA, 20 bp, Artificial sequence
  Synthetic oligonucleotide
gcataacgataatcatgtgg

SEQ ID NO: 891 - DNA, 20 bp, Artificial sequence
  Synthetic oligonucleotide
ggctataggccatttattca

SEQ ID NO: 892 - DNA, 20 bp, Artificial sequence
  Synthetic oligonucleotide
ttgaataactacctaggctc

SEQ ID NO: 893 - DNA, 20 bp, Artificial sequence
  Synthetic oligonucleotide
ccggtgcaggaatccaggat

SEQ ID NO: 894 - DNA, 20 bp, Artificial sequence
  Synthetic oligonucleotide
taacaataagataaaggcgc

SEQ ID NO: 895 - DNA, 20 bp, Artificial sequence
  Synthetic oligonucleotide
ggcaagcaaagactacaccg

SEQ ID NO: 896 - DNA, 20 bp, Artificial sequence
  Synthetic oligonucleotide
gctcctaacattgtatcccc

SEQ ID NO: 897 - DNA, 20 bp, Artificial sequence
  Synthetic oligonucleotide
ctctaccaagctatccaagt

SEQ ID NO: 898 - DNA, 20 bp, Artificial sequence
  Synthetic oligonucleotide
gtcctattggagggccgcac

SEQ ID NO: 899 - DNA, 20 bp, Artificial sequence
  Synthetic oligonucleotide
gtcctccaataagcttctga

SEQ ID NO: 900 - DNA, 20 bp, Artificial sequence
  Synthetic oligonucleotide
gggacaatactgcaatcctt

SEQ ID NO: 901 - DNA, 20 bp, Artificial sequence
  Synthetic oligonucleotide
agagacctcaagacctatag

SEQ ID NO: 902 - DNA, 20 bp, Artificial sequence
  Synthetic oligonucleotide
gactacttcaacctgatacc

SEQ ID NO: 903 - DNA, 20 bp, Artificial sequence
  Synthetic oligonucleotide
gggcatcattaacataagct

SEQ ID NO: 904 - DNA, 20 bp, Artificial sequence
  Synthetic oligonucleotide
acaaacgggctatgtgagat

SEQ ID NO: 905 - DNA, 20 bp, Artificial sequence
  Synthetic oligonucleotide
cactgagtttttgtagttcg

SEQ ID NO: 906 - DNA, 20 bp, Artificial sequence
  Synthetic oligonucleotide
ggcagttgtgatagtcaaca

SEQ ID NO: 907 - DNA, 20 bp, Artificial sequence
  Synthetic oligonucleotide
tagaggccctcttgtttcaa

SEQ ID NO: 908 - DNA, 20 bp, Artificial sequence
  Synthetic oligonucleotide
ggattttattggtcatctcg

SEQ ID NO: 909 - DNA, 20 bp, Artificial sequence
  Synthetic oligonucleotide
gtagttacttatactggttc

SEQ ID NO: 910 - DNA, 20 bp, Artificial sequence
  Synthetic oligonucleotide
gtgggttcctgatggagtcc

SEQ ID NO: 911 - DNA, 20 bp, Artificial sequence
  Synthetic oligonucleotide
ctaggttgcataaagccagg

SEQ ID NO: 912 - DNA, 20 bp, Artificial sequence
  Synthetic oligonucleotide
gccttaaaagggttccctgt

SEQ ID NO: 913 - DNA, 20 bp, Artificial sequence
  Synthetic oligonucleotide
ggtcatgatgtatgccatta

SEQ ID NO: 914 - DNA, 20 bp, Artificial sequence
  Synthetic oligonucleotide
atctagcttgaatggatacc

SEQ ID NO: 915 - DNA, 20 bp, Artificial sequence
  Synthetic oligonucleotide
gttctttctcggtcaaacta

SEQ ID NO: 916 - DNA, 20 bp, Artificial sequence
  Synthetic oligonucleotide
tacgagttgctggtttcagc

SEQ ID NO: 917 - DNA, 20 bp, Artificial sequence
  Synthetic oligonucleotide
ggttagggctatgttatgtt

SEQ ID NO: 918 - DNA, 20 bp, Artificial sequence
  Synthetic oligonucleotide
gattccacttgtgtatgcac

SEQ ID NO: 919 - DNA, 20 bp, Artificial sequence
  Synthetic oligonucleotide
catatactaaatgttgccga

SEQ ID NO: 920 - DNA, 20 bp, Artificial sequence
  Synthetic oligonucleotide
atacagaattcaatggaccc

SEQ ID NO: 921 - DNA, 20 bp, Artificial sequence
  Synthetic oligonucleotide
gcctaggaccagttggttca

SEQ ID NO: 922 - DNA, 20 bp, Artificial sequence
  Synthetic oligonucleotide
ggctgttgtacattcctagt

SEQ ID NO: 923 - DNA, 20 bp, Artificial sequence
  Synthetic oligonucleotide
ccctaagcttagatataccc

SEQ ID NO: 924 - DNA, 20 bp, Artificial sequence
  Synthetic oligonucleotide
aggtgggaaaccggttccca

SEQ ID NO: 925 - DNA, 20 bp, Artificial sequence
  Synthetic oligonucleotide
ggtcggtccccaccaaagga

SEQ ID NO: 926 - DNA, 20 bp, Artificial sequence
  Synthetic oligonucleotide
gccatgtacgaccctcatca

SEQ ID NO: 927 - DNA, 20 bp, Artificial sequence
  Synthetic oligonucleotide
tactataatacgggacctca

SEQ ID NO: 928 - DNA, 20 bp, Artificial sequence
  Synthetic oligonucleotide
atcacattcaaggtagcccc

SEQ ID NO: 929 - DNA, 20 bp, Artificial sequence
  Synthetic oligonucleotide
tgaccagcaataggctctgc

SEQ ID NO: 930 - DNA, 20 bp, Artificial sequence
  Synthetic oligonucleotide
actggcctttgggtcggata

SEQ ID NO: 931 - DNA, 20 bp, Artificial sequence
  Synthetic oligonucleotide
ggagtccccagataatgcat

SEQ ID NO: 932 - DNA, 20 bp, Artificial sequence
  Synthetic oligonucleotide
ggatgggctaagagtcacct

SEQ ID NO: 933 - DNA, 20 bp, Artificial sequence
  Synthetic oligonucleotide
ggtattaaggcccttggcca

SEQ ID NO: 934 - DNA, 20 bp, Artificial sequence
  Synthetic oligonucleotide
ggcccgatgacaccagccac

SEQ ID NO: 935 - DNA, 20 bp, Artificial sequence
  Synthetic oligonucleotide
taacagtcctgtaaccagac

SEQ ID NO: 936 - DNA, 20 bp, Artificial sequence
  Synthetic oligonucleotide
ccccctgagatccatgaggt

SEQ ID NO: 937 - DNA, 20 bp, Artificial sequence
  Synthetic oligonucleotide
cagttgtgcagttgttaact

SEQ ID NO: 938 - DNA, 20 bp, Artificial sequence
  Synthetic oligonucleotide
aaccagatggctgagctatt

SEQ ID NO: 939 - DNA, 20 bp, Artificial sequence
  Synthetic oligonucleotide
ttaggccatacctcttccat

SEQ ID NO: 940 - DNA, 20 bp, Artificial sequence
  Synthetic oligonucleotide
ttagtctgttgtgtgactcc

SEQ ID NO: 941 - DNA, 20 bp, Artificial sequence
  Synthetic oligonucleotide
ccacctaagagctatccgct

SEQ ID NO: 942 - DNA, 20 bp, Artificial sequence
  Synthetic oligonucleotide
ggccgaccagctctgaaagt

SEQ ID NO: 943 - DNA, 20 bp, Artificial sequence
  Synthetic oligonucleotide
accagggtggtattataaag

SEQ ID NO: 944 - DNA, 20 bp, Artificial sequence
  Synthetic oligonucleotide
caggttgtggaggttgttcc

SEQ ID NO: 945 - DNA, 20 bp, Artificial sequence
  Synthetic oligonucleotide
gttgtctggcatggagatcc

SEQ ID NO: 946 - DNA, 20 bp, Artificial sequence
  Synthetic oligonucleotide
gttgattggaggcactgcag

SEQ ID NO: 947 - DNA, 20 bp, Artificial sequence
  Synthetic oligonucleotide
tggtgagtaaatcaatcacg

SEQ ID NO: 948 - DNA, 20 bp, Artificial sequence
  Synthetic oligonucleotide
cccttcaacatgtgttaacg

SEQ ID NO: 949 - DNA, 20 bp, Artificial sequence
  Synthetic oligonucleotide
cgtggctgtacctgcagtgc

SEQ ID NO: 950 - DNA, 20 bp, Artificial sequence
  Synthetic oligonucleotide
gactctgattgattcagtgc

SEQ ID NO: 951 - DNA, 20 bp, Artificial sequence
  Synthetic oligonucleotide
agtacaaaccactaagggta

SEQ ID NO: 952 - DNA, 20 bp, Artificial sequence
  Synthetic oligonucleotide
gtgccatataatgttgaagc

SEQ ID NO: 953 - DNA, 20 bp, Artificial sequence
  Synthetic oligonucleotide
cgtgtctgaactggcctgtg

SEQ ID NO: 954 - DNA, 20 bp, Artificial sequence
  Synthetic oligonucleotide
cataacctctcctcgagaca

SEQ ID NO: 955 - DNA, 20 bp, Artificial sequence
  Synthetic oligonucleotide
tctgtcacgcttcccttggc

SEQ ID NO: 956 - DNA, 20 bp, Artificial sequence
  Synthetic oligonucleotide
tcactggtgtggtatcatgc

SEQ ID NO: 957 - DNA, 20 bp, Artificial sequence
  Synthetic oligonucleotide
gattgcatctcttgcagcac

SEQ ID NO: 958 - DNA, 20 bp, Artificial sequence
  Synthetic oligonucleotide
ctcacctgtgtatatgagtc

SEQ ID NO: 959 - DNA, 20 bp, Artificial sequence
  Synthetic oligonucleotide
acactgttagagcccccaca

SEQ ID NO: 960 - DNA, 20 bp, Artificial sequence
  Synthetic oligonucleotide
gcataggaatgggaccatag

SEQ ID NO: 961 - DNA, 20 bp, Artificial sequence
  Synthetic oligonucleotide
gcatcatacatagtgtatgc

SEQ ID NO: 962 - DNA, 20 bp, Artificial sequence
  Synthetic oligonucleotide
cttgtctcacaattgttacc

SEQ ID NO: 963 - DNA, 20 bp, Artificial sequence
  Synthetic oligonucleotide
taactgtagcgcattgagca

SEQ ID NO: 964 - DNA, 20 bp, Artificial sequence
  Synthetic oligonucleotide
gctagtcactcattgagaag

SEQ ID NO: 965 - DNA, 20 bp, Artificial sequence
  Synthetic oligonucleotide
tagataggctataggccatt

SEQ ID NO: 966 - DNA, 20 bp, Artificial sequence
  Synthetic oligonucleotide
gcatatatcttaactcaccc

SEQ ID NO: 967 - DNA, 20 bp, Artificial sequence
  Synthetic oligonucleotide
aaaagccggtgcaggaatcc

SEQ ID NO: 968 - DNA, 20 bp, Artificial sequence
  Synthetic oligonucleotide
taagtgcccatggcatagtc

SEQ ID NO: 969 - DNA, 20 bp, Artificial sequence
  Synthetic oligonucleotide
gagtgctgaagaacatcccc

SEQ ID NO: 970 - DNA, 20 bp, Artificial sequence
  Synthetic oligonucleotide
caagtctactaccaataagt

SEQ ID NO: 971 - DNA, 20 bp, Artificial sequence
  Synthetic oligonucleotide
cgtcagcattgcttgatctc

SEQ ID NO: 972 - DNA, 20 bp, Artificial sequence
  Synthetic oligonucleotide
tatttgtcctattggagggc

SEQ ID NO: 973 - DNA, 20 bp, Artificial sequence
  Synthetic oligonucleotide
catggtgagggtctcaatga

SEQ ID NO: 974 - DNA, 20 bp, Artificial sequence
  Synthetic oligonucleotide
gagacatgtgccagttcaag

SEQ ID NO: 975 - DNA, 20 bp, Artificial sequence
  Synthetic oligonucleotide
ggacactggcacatctatag

SEQ ID NO: 976 - DNA, 20 bp, Artificial sequence
  Synthetic oligonucleotide
ctgtataactgattgactac

SEQ ID NO: 977 - DNA, 20 bp, Artificial sequence
  Synthetic oligonucleotide
gctcatctatggattgcatt

SEQ ID NO: 978 - DNA, 20 bp, Artificial sequence
  Synthetic oligonucleotide
gtacaaacgggctatgtgag

SEQ ID NO: 979 - DNA, 20 bp, Artificial sequence
  Synthetic oligonucleotide
agctataggtacctgaagtt

SEQ ID NO: 980 - DNA, 20 bp, Artificial sequence
  Synthetic oligonucleotide
cttagcttgcccagagcata

SEQ ID NO: 981 - DNA, 20 bp, Artificial sequence
  Synthetic oligonucleotide
gcgaatagaggccctcttgt

SEQ ID NO: 982 - DNA, 20 bp, Artificial sequence
  Synthetic oligonucleotide
gatgtgtataggtgttggtc

SEQ ID NO: 983 - DNA, 20 bp, Artificial sequence
  Synthetic oligonucleotide
ccattttggtgctataaccc

SEQ ID NO: 984 - DNA, 20 bp, Artificial sequence
  Synthetic oligonucleotide
cttataggtgggttcctgat

SEQ ID NO: 985 - DNA, 20 bp, Artificial sequence
  Synthetic oligonucleotide
tctctaggttgcataaagcc

SEQ ID NO: 986 - DNA, 20 bp, Artificial sequence
  Synthetic oligonucleotide
gcacttgtatagttcatccc

SEQ ID NO: 987 - DNA, 20 bp, Artificial sequence
  Synthetic oligonucleotide
atcctgcatccgaggcatga

SEQ ID NO: 988 - DNA, 20 bp, Artificial sequence
  Synthetic oligonucleotide
gtggttgccttagtattaca

SEQ ID NO: 989 - DNA, 20 bp, Artificial sequence
  Synthetic oligonucleotide
ctgtaaggtgatatctatac

SEQ ID NO: 990 - DNA, 20 bp, Artificial sequence
  Synthetic oligonucleotide
tgttcatacgagttgctggt

SEQ ID NO: 991 - DNA, 20 bp, Artificial sequence
  Synthetic oligonucleotide
cgcaatgtatcaggcaacag

SEQ ID NO: 992 - DNA, 20 bp, Artificial sequence
  Synthetic oligonucleotide
gagggcacaatgattccact

SEQ ID NO: 993 - DNA, 20 bp, Artificial sequence
  Synthetic oligonucleotide
ggagttacaagtgtcatata

SEQ ID NO: 994 - DNA, 20 bp, Artificial sequence
  Synthetic oligonucleotide
ggctctatgcacttaaggga

SEQ ID NO: 995 - DNA, 20 bp, Artificial sequence
  Synthetic oligonucleotide
gatcatgtgcatacccaggg

SEQ ID NO: 996 - DNA, 20 bp, Artificial sequence
  Synthetic oligonucleotide
ggtcagattcctaaatacgc

SEQ ID NO: 997 - DNA, 20 bp, Artificial sequence
  Synthetic oligonucleotide
gtgtcatatgtagcaattag

SEQ ID NO: 998 - DNA, 20 bp, Artificial sequence
  Synthetic oligonucleotide
cacctgtataggagaattgt

SEQ ID NO: 999 - DNA, 20 bp, Artificial sequence
  Synthetic oligonucleotide
ccactcccgtggcaacatga

SEQ ID NO: 1000 - DNA, 20 bp, Artificial sequence
  Synthetic oligonucleotide
gggtaagaggtcggtcccca

SEQ ID NO: 1001 - DNA, 20 bp, Artificial sequence
  Synthetic oligonucleotide
ggaggccatgtacgaccctc

SEQ ID NO: 1002 - DNA, 20 bp, Artificial sequence
  Synthetic oligonucleotide
gctgcaatactataatacgg

SEQ ID NO: 1003 - DNA, 20 bp, Artificial sequence
  Synthetic oligonucleotide
agctgaggtcaccgatcaga

SEQ ID NO: 1004 - DNA, 20 bp, Artificial sequence
  Synthetic oligonucleotide
aacagtgaccagcaataggc

SEQ ID NO: 1005 - DNA, 20 bp, Artificial sequence
  Synthetic oligonucleotide
ctaactggcctttgggtcgg

SEQ ID NO: 1006 - DNA, 20 bp, Artificial sequence
  Synthetic oligonucleotide
gggaggagtccccagataat

SEQ ID NO: 1007 - DNA, 20 bp, Artificial sequence
  Synthetic oligonucleotide
ggcccaagtgatgacatatc

SEQ ID NO: 1008 - DNA, 20 bp, Artificial sequence
  Synthetic oligonucleotide
gtaaggcatggtcttccttg

SEQ ID NO: 1009 - DNA, 20 bp, Artificial sequence
  Synthetic oligonucleotide
aatatggcccgatgacacca

SEQ ID NO: 1010 - DNA, 20 bp, Artificial sequence
  Synthetic oligonucleotide
gcaagattaacagtcctgta

SEQ ID NO: 1011 - DNA, 20 bp, Artificial sequence
  Synthetic oligonucleotide
tcagctcaacaccccctgag

SEQ ID NO: 1012 - DNA, 20 bp, Artificial sequence
  Synthetic oligonucleotide
agggtcagttgtgcagttgt

SEQ ID NO: 1013 - DNA, 20 bp, Artificial sequence
  Synthetic oligonucleotide
gcaaggaatcatgtggctcc

SEQ ID NO: 1014 - DNA, 20 bp, Artificial sequence
  Synthetic oligonucleotide
ccaaagatttaggccatacc

SEQ ID NO: 1015 - DNA, 20 bp, Artificial sequence
  Synthetic oligonucleotide
gtaaccttcacataagctgc

SEQ ID NO: 1016 - DNA, 20 bp, Artificial sequence
  Synthetic oligonucleotide
ggcctagcttccacctaaga

SEQ ID NO: 1017 - DNA, 20 bp, Artificial sequence
  Synthetic oligonucleotide
cgctggccgaccagctctga

SEQ ID NO: 1018 - DNA, 20 bp, Artificial sequence
  Synthetic oligonucleotide
cgtctaccagggtggtatta

SEQ ID NO: 1019 - DNA, 20 bp, Artificial sequence
  Synthetic oligonucleotide
atactccaggttgtggaggt

SEQ ID NO: 1020 - DNA, 20 bp, Artificial sequence
  Synthetic oligonucleotide
caaattggtgaatgttcccc

SEQ ID NO: 1021 - DNA, 20 bp, Artificial sequence
  Synthetic oligonucleotide
tctcatgaccacctaattga

SEQ ID NO: 1022 - DNA, 20 bp, Artificial sequence
  Synthetic oligonucleotide
ccgtgctgctttcttgagtg

SEQ ID NO: 1023 - DNA, 20 bp, Artificial sequence
  Synthetic oligonucleotide
acatgcttgcatccaggccc

SEQ ID NO: 1024 - DNA, 20 bp, Artificial sequence
  Synthetic oligonucleotide
cggaacccacagtagaggca

SEQ ID NO: 1025 - DNA, 20 bp, Artificial sequence
  Synthetic oligonucleotide
ctagggactctgattgattc

SEQ ID NO: 1026 - DNA, 20 bp, Artificial sequence
  Synthetic oligonucleotide
accaggcataagtacaaacc

SEQ ID NO: 1027 - DNA, 20 bp, Artificial sequence
  Synthetic oligonucleotide
ctgagtgccatataatgttg

SEQ ID NO: 1028 - DNA, 20 bp, Artificial sequence
  Synthetic oligonucleotide
aaggctctcagggtaagacg

SEQ ID NO: 1029 - DNA, 20 bp, Artificial sequence
  Synthetic oligonucleotide
cgtggaacactgacccatca

SEQ ID NO: 1030 - DNA, 20 bp, Artificial sequence
  Synthetic oligonucleotide
cagcatgtaactcatgttgt

SEQ ID NO: 1031 - DNA, 20 bp, Artificial sequence
  Synthetic oligonucleotide
gttctaaagtcggttgtgtc

SEQ ID NO: 1032 - DNA, 20 bp, Artificial sequence
  Synthetic oligonucleotide
agagtaggccaggtgtcaaa

SEQ ID NO: 1033 - DNA, 20 bp, Artificial sequence
  Synthetic oligonucleotide
taccagtgagtaaactggcc

SEQ ID NO: 1034 - DNA, 20 bp, Artificial sequence
  Synthetic oligonucleotide
gtactccccatgcacacttg

SEQ ID NO: 1035 - DNA, 20 bp, Artificial sequence
  Synthetic oligonucleotide
acggattatcataccctccc

SEQ ID NO: 1036 - DNA, 20 bp, Artificial sequence
  Synthetic oligonucleotide
gtcttgtaaacccttaccag

SEQ ID NO: 1037 - DNA, 20 bp, Artificial sequence
  Synthetic oligonucleotide
ccgttacttaagctgtggta

SEQ ID NO: 1038 - DNA, 20 bp, Artificial sequence
  Synthetic oligonucleotide
tagtgccagtaggacttact

SEQ ID NO: 1039 - DNA, 20 bp, Artificial sequence
  Synthetic oligonucleotide
ggacccttaagtcataaaga

SEQ ID NO: 1040 - DNA, 20 bp, Artificial sequence
  Synthetic oligonucleotide
gaccaaatgagcatcacatc

SEQ ID NO: 1041 - DNA, 20 bp, Artificial sequence
  Synthetic oligonucleotide
cctgtatgtatggcttatgc

SEQ ID NO: 1042 - DNA, 20 bp, Artificial sequence
  Synthetic oligonucleotide
atccatagtgatctgggaac

SEQ ID NO: 1043 - DNA, 20 bp, Artificial sequence
  Synthetic oligonucleotide
actataattgggaatggtca

SEQ ID NO: 1044 - DNA, 20 bp, Artificial sequence
  Synthetic oligonucleotide
gatttgacccttatggagac

SEQ ID NO: 1045 - DNA, 20 bp, Artificial sequence
  Synthetic oligonucleotide
tattccctatccagggtaga

SEQ ID NO: 1046 - DNA, 20 bp, Artificial sequence
  Synthetic oligonucleotide
ttatcctgttgcaatagaac

SEQ ID NO: 1047 - DNA, 20 bp, Artificial sequence
  Synthetic oligonucleotide
attagattaaaatctggccg

SEQ ID NO: 1048 - DNA, 20 bp, Artificial sequence
  Synthetic oligonucleotide
gactcataagacaggatgcc

SEQ ID NO: 1049 - DNA, 20 bp, Artificial sequence
  Synthetic oligonucleotide
ccagccaggtgtcttatatc

SEQ ID NO: 1050 - DNA, 20 bp, Artificial sequence
  Synthetic oligonucleotide
cagttgtgtattgactaagt

SEQ ID NO: 1051 - DNA, 20 bp, Artificial sequence
  Synthetic oligonucleotide
aagactatcctggtatgact

SEQ ID NO: 1052 - DNA, 20 bp, Artificial sequence
  Synthetic oligonucleotide
tcgatgttcttgcttccctg

SEQ ID NO: 1053 - DNA, 20 bp, Artificial sequence
  Synthetic oligonucleotide
ggcagctcctgacaaattag

SEQ ID NO: 1054 - DNA, 20 bp, Artificial sequence
  Synthetic oligonucleotide
agacccctcccttaatgtaa

SEQ ID NO: 1055 - DNA, 20 bp, Artificial sequence
  Synthetic oligonucleotide
acctgggtattgctgtccaa

SEQ ID NO: 1056 - DNA, 20 bp, Artificial sequence
  Synthetic oligonucleotide
ctcaccctttactaaggtgc

SEQ ID NO: 1057 - DNA, 20 bp, Artificial sequence
  Synthetic oligonucleotide
ccattggtatgagagatgct

SEQ ID NO: 1058 - DNA, 20 bp, Artificial sequence
  Synthetic oligonucleotide
gtcagacttattgaggatgg

SEQ ID NO: 1059 - DNA, 20 bp, Artificial sequence
  Synthetic oligonucleotide
ttactcctctggtgtgctga

SEQ ID NO: 1060 - DNA, 20 bp, Artificial sequence
  Synthetic oligonucleotide
gcgcacttgggagccagcca

SEQ ID NO: 1061 - DNA, 20 bp, Artificial sequence
  Synthetic oligonucleotide
ttactgactggccttaggag

SEQ ID NO: 1062 - DNA, 20 bp, Artificial sequence
  Synthetic oligonucleotide
gtagtatgcattgacaagct

SEQ ID NO: 1063 - DNA, 20 bp, Artificial sequence
  Synthetic oligonucleotide
gagtatattacctccaggtt

SEQ ID NO: 1064 - DNA, 20 bp, Artificial sequence
  Synthetic oligonucleotide
gtattgctgctctagctcta

SEQ ID NO: 1065 - DNA, 20 bp, Artificial sequence
  Synthetic oligonucleotide
acggacctcatacagtgagt

SEQ ID NO: 1066 - DNA, 20 bp, Artificial sequence
  Synthetic oligonucleotide
gggctcttggaagtctagtt

SEQ ID NO: 1067 - DNA, 20 bp, Artificial sequence
  Synthetic oligonucleotide
acatacttggttgcagacgc

SEQ ID NO: 1068 - DNA, 20 bp, Artificial sequence
  Synthetic oligonucleotide
taggtttgcggatgccagtg

SEQ ID NO: 1069 - DNA, 20 bp, Artificial sequence
  Synthetic oligonucleotide
tacacagtgggatttgcccc

SEQ ID NO: 1070 - DNA, 20 bp, Artificial sequence
  Synthetic oligonucleotide
atggcctgactaggcattga

SEQ ID NO: 1071 - DNA, 20 bp, Artificial sequence
  Synthetic oligonucleotide
ggttactagggccagagaat

SEQ ID NO: 1072 - DNA, 20 bp, Artificial sequence
  Synthetic oligonucleotide
tgttaatagactgcgattat

SEQ ID NO: 1073 - DNA, 20 bp, Artificial sequence
  Synthetic oligonucleotide
gggcggagctgcataggagt

SEQ ID NO: 1074 - DNA, 20 bp, Artificial sequence
  Synthetic oligonucleotide
acaatggaccacctaagacc

SEQ ID NO: 1075 - DNA, 20 bp, Artificial sequence
  Synthetic oligonucleotide
caacccttactctgccaggg

SEQ ID NO: 1076 - DNA, 20 bp, Artificial sequence
  Synthetic oligonucleotide
tgtgcaatagcctaaatgcc

SEQ ID NO: 1077 - DNA, 20 bp, Artificial sequence
  Synthetic oligonucleotide
ctactatgaagttatgcacc

SEQ ID NO: 1078 - DNA, 20 bp, Artificial sequence
  Synthetic oligonucleotide
gttagccttacagcaaatac

SEQ ID NO: 1079 - DNA, 20 bp, Artificial sequence
  Synthetic oligonucleotide
tactaattagcaagccactg

SEQ ID NO: 1080 - DNA, 20 bp, Artificial sequence
  Synthetic oligonucleotide
gtgtcaaatcaatttgtgcc

SEQ ID NO: 1081 - DNA, 20 bp, Artificial sequence
  Synthetic oligonucleotide
ctaagcacatccgatagtca

SEQ ID NO: 1082 - DNA, 20 bp, Artificial sequence
  Synthetic oligonucleotide
ggagtgctctttgtggatgc

SEQ ID NO: 1083 - DNA, 20 bp, Artificial sequence
  Synthetic oligonucleotide
acccatggctcatcagtggg

SEQ ID NO: 1084 - DNA, 20 bp, Artificial sequence
  Synthetic oligonucleotide
ggcagctctttgtaggccca

SEQ ID NO: 1085 - DNA, 20 bp, Artificial sequence
  Synthetic oligonucleotide
ggagtgggttcctataagga

SEQ ID NO: 1086 - DNA, 20 bp, Artificial sequence
  Synthetic oligonucleotide
ggactaataggcctttctac

SEQ ID NO: 1087 - DNA, 20 bp, Artificial sequence
  Synthetic oligonucleotide
ctacagtaccaggtcatttg

SEQ ID NO: 1088 - DNA, 20 bp, Artificial sequence
  Synthetic oligonucleotide
caccaccaaccttaaatagt

SEQ ID NO: 1089 - DNA, 20 bp, Artificial sequence
  Synthetic oligonucleotide
ccatgccacagattggcttg

SEQ ID NO: 1090 - DNA, 20 bp, Artificial sequence
  Synthetic oligonucleotide
cggagccttacgcttggctg

SEQ ID NO: 1091 - DNA, 20 bp, Artificial sequence
  Synthetic oligonucleotide
cagtctgtctctgtgtaccg

SEQ ID NO: 1092 - DNA, 20 bp, Artificial sequence
  Synthetic oligonucleotide
ggttgacaggacatgctgtc

SEQ ID NO: 1093 - DNA, 20 bp, Artificial sequence
  Synthetic oligonucleotide
gttagccgagcattggcttc

SEQ ID NO: 1094 - DNA, 20 bp, Artificial sequence
  Synthetic oligonucleotide
cccatggtggtggaatgctg

SEQ ID NO: 1095 - DNA, 20 bp, Artificial sequence
  Synthetic oligonucleotide
tcccgcaccatgcattctga

SEQ ID NO: 1096 - DNA, 20 bp, Artificial sequence
  Synthetic oligonucleotide
tcagcttccttcagtgggcg

SEQ ID NO: 1097 - DNA, 20 bp, Artificial sequence
  Synthetic oligonucleotide
gatctcacacatggcactgc

SEQ ID NO: 1098 - DNA, 20 bp, Artificial sequence
  Synthetic oligonucleotide
taccagtaaagggtagtata

SEQ ID NO: 1099 - DNA, 20 bp, Artificial sequence
  Synthetic oligonucleotide
gtaaatatacacttgggccc

SEQ ID NO: 1100 - DNA, 20 bp, Artificial sequence
  Synthetic oligonucleotide
tagctgaacctgtggctagg

SEQ ID NO: 1101 - DNA, 20 bp, Artificial sequence
  Synthetic oligonucleotide
agtgtcaggctgtaagggat

SEQ ID NO: 1102 - DNA, 20 bp, Artificial sequence
  Synthetic oligonucleotide
gccataggtttcaggctgat

SEQ ID NO: 1103 - DNA, 20 bp, Artificial sequence
  Synthetic oligonucleotide
gagatgggctatgagccatc

SEQ ID NO: 1104 - DNA, 20 bp, Artificial sequence
  Synthetic oligonucleotide
ggaccagcgggccgaacgca

SEQ ID NO: 1105 - DNA, 20 bp, Artificial sequence
  Synthetic oligonucleotide
atgcaaaggtgtcgatttgt

SEQ ID NO: 1106 - DNA, 20 bp, Artificial sequence
  Synthetic oligonucleotide
ggtccatagatgtcagttac

SEQ ID NO: 1107 - DNA, 20 bp, Artificial sequence
  Synthetic oligonucleotide
attaatgttctatggtggat

SEQ ID NO: 1108 - DNA, 20 bp, Artificial sequence
  Synthetic oligonucleotide
ggagtagaatgcccactggg

SEQ ID NO: 1109 - DNA, 20 bp, Artificial sequence
  Synthetic oligonucleotide
gagacctgaatataccttac

SEQ ID NO: 1110 - DNA, 20 bp, Artificial sequence
  Synthetic oligonucleotide
ggtatgccaggtttttgaca

SEQ ID NO: 1111 - DNA, 20 bp, Artificial sequence
  Synthetic oligonucleotide
ccgtgtaatgacacacctct

SEQ ID NO: 1112 - DNA, 20 bp, Artificial sequence
  Synthetic oligonucleotide
aggctatagtcaaagggtgg

SEQ ID NO: 1113 - DNA, 20 bp, Artificial sequence
  Synthetic oligonucleotide
gtgtcagtcaatcattgaga

SEQ ID NO: 1114 - DNA, 20 bp, Artificial sequence
  Synthetic oligonucleotide
ggtcttatttaccattggca

SEQ ID NO: 1115 - DNA, 20 bp, Artificial sequence
  Synthetic oligonucleotide
taacatgttgcttgcactcc

SEQ ID NO: 1116 - DNA, 20 bp, Artificial sequence
  Synthetic oligonucleotide
gctcaaactagaatacccca

SEQ ID NO: 1117 - DNA, 20 bp, Artificial sequence
  Synthetic oligonucleotide
gtctaggtctcacgctgtgt

SEQ ID NO: 1118 - DNA, 20 bp, Artificial sequence
  Synthetic oligonucleotide
gacagtggagtcaagttggt

SEQ ID NO: 1119 - DNA, 20 bp, Artificial sequence
  Synthetic oligonucleotide
ggactccacacacctactag

SEQ ID NO: 1120 - DNA, 20 bp, Artificial sequence
  Synthetic oligonucleotide
gtgggatggctgtcaatgct

SEQ ID NO: 1121 - DNA, 20 bp, Artificial sequence
  Synthetic oligonucleotide
gataattgaggagttcacca

SEQ ID NO: 1122 - DNA, 20 bp, Artificial sequence
  Synthetic oligonucleotide
gatccaaacaagcaccctcc

SEQ ID NO: 1123 - DNA, 20 bp, Artificial sequence
  Synthetic oligonucleotide
tatcacagttgcttgaccct

SEQ ID NO: 1124 - DNA, 20 bp, Artificial sequence
  Synthetic oligonucleotide
gatctattatgagggcatca

SEQ ID NO: 1125 - DNA, 20 bp, Artificial sequence
  Synthetic oligonucleotide
agctttagtatgtcgagaac

SEQ ID NO: 1126 - DNA, 20 bp, Artificial sequence
  Synthetic oligonucleotide
gtgtggatggtatcctggtc

SEQ ID NO: 1127 - DNA, 20 bp, Artificial sequence
  Synthetic oligonucleotide
ggaatgcttgatctgtgggc

SEQ ID NO: 1128 - DNA, 20 bp, Artificial sequence
  Synthetic oligonucleotide
gctagactagttgaaatcgg

SEQ ID NO: 1129 - DNA, 20 bp, Artificial sequence
  Synthetic oligonucleotide
ccctcccatcagtgaagatt

SEQ ID NO: 1130 - DNA, 20 bp, Artificial sequence
  Synthetic oligonucleotide
gctttagaggtcaaatagtg

SEQ ID NO: 1131 - DNA, 20 bp, Artificial sequence
  Synthetic oligonucleotide
ctggtcttcctcgaggatag

SEQ ID NO: 1132 - DNA, 20 bp, Artificial sequence
  Synthetic oligonucleotide
gtcatctcgggtatataaat

SEQ ID NO: 1133 - DNA, 20 bp, Artificial sequence
  Synthetic oligonucleotide
ggacaagtcttatagagaac

SEQ ID NO: 1134 - DNA, 20 bp, Artificial sequence
  Synthetic oligonucleotide
gttccaagtatgggctgctg

SEQ ID NO: 1135 - DNA, 20 bp, Artificial sequence
  Synthetic oligonucleotide
gtcaacatgtgcttgcaagc

SEQ ID NO: 1136 - DNA, 20 bp, Artificial sequence
  Synthetic oligonucleotide
gctgttgatacgctccttca

SEQ ID NO: 1137 - DNA, 20 bp, Artificial sequence
  Synthetic oligonucleotide
gaggcactgaagttcactac

SEQ ID NO: 1138 - DNA, 20 bp, Artificial sequence
  Synthetic oligonucleotide
agggtcccacttgtttaggt

SEQ ID NO: 1139 - DNA, 20 bp, Artificial sequence
  Synthetic oligonucleotide
cgtattaaggtgttgtatga

SEQ ID NO: 1140 - DNA, 20 bp, Artificial sequence
  Synthetic oligonucleotide
ccttgtgacaatagtagtga

SEQ ID NO: 1141 - DNA, 20 bp, Artificial sequence
  Synthetic oligonucleotide
ggctagatggagcttgagcc

SEQ ID NO: 1142 - DNA, 20 bp, Artificial sequence
  Synthetic oligonucleotide
cgtgagctatctgtacaaaa

SEQ ID NO: 1143 - DNA, 20 bp, Artificial sequence
  Synthetic oligonucleotide
gtgcataatggtctaccaca

SEQ ID NO: 1144 - DNA, 20 bp, Artificial sequence
  Synthetic oligonucleotide
tgaagataggtcagttaacg

SEQ ID NO: 1145 - DNA, 20 bp, Artificial sequence
  Synthetic oligonucleotide
gttaagctttcacctatagg

SEQ ID NO: 1146 - DNA, 20 bp, Artificial sequence
  Synthetic oligonucleotide
tgatcatatgggtggtcgct

SEQ ID NO: 1147 - DNA, 20 bp, Artificial sequence
  Synthetic oligonucleotide
attgtcctcctggtaaccac

SEQ ID NO: 1148 - DNA, 20 bp, Artificial sequence
  Synthetic oligonucleotide
gggactggtgccacaccatc

SEQ ID NO: 1149 - DNA, 20 bp, Artificial sequence
  Synthetic oligonucleotide
ctaacctggatctcagatag

SEQ ID NO: 1150 - DNA, 20 bp, Artificial sequence
  Synthetic oligonucleotide
ctgggccccaattcagtaat

SEQ ID NO: 1151 - DNA, 20 bp, Artificial sequence
  Synthetic oligonucleotide
ttggtaaaggagggaatcgg

SEQ ID NO: 1152 - DNA, 20 bp, Artificial sequence
  Synthetic oligonucleotide
tccaggatatatgttagtcc

SEQ ID NO: 1153 - DNA, 20 bp, Artificial sequence
  Synthetic oligonucleotide
tagctacaataagttgtagc

SEQ ID NO: 1154 - DNA, 20 bp, Artificial sequence
  Synthetic oligonucleotide
gagggccatgttaaaggcct

SEQ ID NO: 1155 - DNA, 20 bp, Artificial sequence
  Synthetic oligonucleotide
ttttggtaggtaactacggg

SEQ ID NO: 1156 - DNA, 20 bp, Artificial sequence
  Synthetic oligonucleotide
tgtagctcagctcaatgtgt

SEQ ID NO: 1157 - DNA, 20 bp, Artificial sequence
  Synthetic oligonucleotide
gaactgcactgggttgtctc

SEQ ID NO: 1158 - DNA, 20 bp, Artificial sequence
  Synthetic oligonucleotide
gtattgcactcacatactgt

SEQ ID NO: 1159 - DNA, 20 bp, Artificial sequence
  Synthetic oligonucleotide
agccaatgcgcaagaaaagt

SEQ ID NO: 1160 - DNA, 20 bp, Artificial sequence
  Synthetic oligonucleotide
cataggcataaagcctccta

SEQ ID NO: 1161 - DNA, 20 bp, Artificial sequence
  Synthetic oligonucleotide
tcccagaaatggtcctcgca

SEQ ID NO: 1162 - DNA, 20 bp, Artificial sequence
  Synthetic oligonucleotide
atgtgggtctgcaccaagtt

SEQ ID NO: 1163 - DNA, 20 bp, Artificial sequence
  Synthetic oligonucleotide
ggtgaactcctgtgactgat

SEQ ID NO: 1164 - DNA, 20 bp, Artificial sequence
  Synthetic oligonucleotide
gtggagtaggtatattagtc

SEQ ID NO: 1165 - DNA, 20 bp, Artificial sequence
  Synthetic oligonucleotide
gtattcctgaagtagtcctg

SEQ ID NO: 1166 - DNA, 20 bp, Artificial sequence
  Synthetic oligonucleotide
agaaattgggccgcctctgt

SEQ ID NO: 1167 - DNA, 20 bp, Artificial sequence
  Synthetic oligonucleotide
gtgcttagtgaactgtgggc

SEQ ID NO: 1168 - DNA, 20 bp, Artificial sequence
  Synthetic oligonucleotide
ccggcatgcatcagctctga

SEQ ID NO: 1169 - DNA, 20 bp, Artificial sequence
  Synthetic oligonucleotide
taagaagcttgcctttcgat

SEQ ID NO: 1170 - DNA, 20 bp, Artificial sequence
  Synthetic oligonucleotide
gcagtgctactgtgccctta

SEQ ID NO: 1171 - DNA, 20 bp, Artificial sequence
  Synthetic oligonucleotide
tccagccctcagtatataga

SEQ ID NO: 1172 - DNA, 20 bp, Artificial sequence
  Synthetic oligonucleotide
ccgaagtggaagtagtcatg

SEQ ID NO: 1173 - DNA, 20 bp, Artificial sequence
  Synthetic oligonucleotide
tgaatgccaccgtgattgca

SEQ ID NO: 1174 - DNA, 20 bp, Artificial sequence
  Synthetic oligonucleotide
cgtagtgtcatcaccataaa

SEQ ID NO: 1175 - DNA, 20 bp, Artificial sequence
  Synthetic oligonucleotide
gttgtgtctgagggatatcc

SEQ ID NO: 1176 - DNA, 20 bp, Artificial sequence
  Synthetic oligonucleotide
gccgaatcttgacatacagg

SEQ ID NO: 1177 - DNA, 20 bp, Artificial sequence
  Synthetic oligonucleotide
gattaccaaaaagggaccag

SEQ ID NO: 1178 - DNA, 20 bp, Artificial sequence
  Synthetic oligonucleotide
ctcctaccaataatggagtc

SEQ ID NO: 1179 - DNA, 20 bp, Artificial sequence
  Synthetic oligonucleotide
cggacacactgggaccagcg

SEQ ID NO: 1180 - DNA, 20 bp, Artificial sequence
  Synthetic oligonucleotide
gctcctatcaagcttttccc

SEQ ID NO: 1181 - DNA, 20 bp, Artificial sequence
  Synthetic oligonucleotide
tgaggtgcattttctagccc

SEQ ID NO: 1182 - DNA, 20 bp, Artificial sequence
  Synthetic oligonucleotide
atctatggagtcatctcccc

SEQ ID NO: 1183 - DNA, 20 bp, Artificial sequence
  Synthetic oligonucleotide
ggtagaggttaatctatgtc

SEQ ID NO: 1184 - DNA, 20 bp, Artificial sequence
  Synthetic oligonucleotide
cgtcggtaaaggaagctact

SEQ ID NO: 1185 - DNA, 20 bp, Artificial sequence
  Synthetic oligonucleotide
tcataaggacaaggtatgcc

SEQ ID NO: 1186 - DNA, 20 bp, Artificial sequence
  Synthetic oligonucleotide
ggacctcattagatcagtca

SEQ ID NO: 1187 - DNA, 20 bp, Artificial sequence
  Synthetic oligonucleotide
ggcagttgagtggtgtcagt

SEQ ID NO: 1188 - DNA, 20 bp, Artificial sequence
  Synthetic oligonucleotide
ggattgcatcacatgtgtca

SEQ ID NO: 1189 - DNA, 20 bp, Artificial sequence
  Synthetic oligonucleotide
tataagtgtccataaaggtc

SEQ ID NO: 1190 - DNA, 20 bp, Artificial sequence
  Synthetic oligonucleotide
ggcattaacatgttgcttgc

SEQ ID NO: 1191 - DNA, 20 bp, Artificial sequence
  Synthetic oligonucleotide
gaattgataagtggtcttct

SEQ ID NO: 1192 - DNA, 20 bp, Artificial sequence
  Synthetic oligonucleotide
gggaagtctaggtctcacgc

SEQ ID NO: 1193 - DNA, 20 bp, Artificial sequence
  Synthetic oligonucleotide
ctacatatgacagtggagtc

SEQ ID NO: 1194 - DNA, 20 bp, Artificial sequence
  Synthetic oligonucleotide
tgagtggactccacacacct

SEQ ID NO: 1195 - DNA, 20 bp, Artificial sequence
  Synthetic oligonucleotide
gatattgcagtgggatggct

SEQ ID NO: 1196 - DNA, 20 bp, Artificial sequence
  Synthetic oligonucleotide
cgtgatagtgctattgtgag

SEQ ID NO: 1197 - DNA, 20 bp, Artificial sequence
  Synthetic oligonucleotide
catcgatccaaacaagcacc

SEQ ID NO: 1198 - DNA, 20 bp, Artificial sequence
  Synthetic oligonucleotide
gcttagctactcacccctgt

SEQ ID NO: 1199 - DNA, 20 bp, Artificial sequence
  Synthetic oligonucleotide
cccacttgatctattatgag

SEQ ID NO: 1200 - DNA, 20 bp, Artificial sequence
  Synthetic oligonucleotide
ccctaatatagggcagatga

SEQ ID NO: 1201 - DNA, 20 bp, Artificial sequence
  Synthetic oligonucleotide
agtgtggatggtatcctggt

SEQ ID NO: 1202 - DNA, 20 bp, Artificial sequence
  Synthetic oligonucleotide
ggatttgagcctgctatgtc

SEQ ID NO: 1203 - DNA, 20 bp, Artificial sequence
  Synthetic oligonucleotide
cattcagctagactagttga

SEQ ID NO: 1204 - DNA, 20 bp, Artificial sequence
  Synthetic oligonucleotide
tatggccctcccatcagtga

SEQ ID NO: 1205 - DNA, 20 bp, Artificial sequence
  Synthetic oligonucleotide
tagattgggctttagaggtc

SEQ ID NO: 1206 - DNA, 20 bp, Artificial sequence
  Synthetic oligonucleotide
acatctggtcttcctcgagg

SEQ ID NO: 1207 - DNA, 20 bp, Artificial sequence
  Synthetic oligonucleotide
ggtcatctcgggtatataaa

SEQ ID NO: 1208 - DNA, 20 bp, Artificial sequence
  Synthetic oligonucleotide
accgaaggagttcctttagc

SEQ ID NO: 1209 - DNA, 20 bp, Artificial sequence
  Synthetic oligonucleotide
ggcagttccaagtatgggct

SEQ ID NO: 1210 - DNA, 20 bp, Artificial sequence
  Synthetic oligonucleotide
gtggagccagctgtcaacat

SEQ ID NO: 1211 - DNA, 20 bp, Artificial sequence
  Synthetic oligonucleotide
tggaatgtatcctgtacggg

SEQ ID NO: 1212 - DNA, 20 bp, Artificial sequence
  Synthetic oligonucleotide
gtgttatactattgtggtgc

SEQ ID NO: 1213 - DNA, 20 bp, Artificial sequence
  Synthetic oligonucleotide
gtttgttagggtcccacttg

SEQ ID NO: 1214 - DNA, 20 bp, Artificial sequence
  Synthetic oligonucleotide
tctgctattgttggatatcg

SEQ ID NO: 1215 - DNA, 20 bp, Artificial sequence
  Synthetic oligonucleotide
atggttagtttaagaaatcg

SEQ ID NO: 1216 - DNA, 20 bp, Artificial sequence
  Synthetic oligonucleotide
gagtcctggttgatgtggtg

SEQ ID NO: 1217 - DNA, 20 bp, Artificial sequence
  Synthetic oligonucleotide
acgggcatgctttataatta

SEQ ID NO: 1218 - DNA, 20 bp, Artificial sequence
  Synthetic oligonucleotide
aacctttgtgcataatggtc

SEQ ID NO: 1219 - DNA, 20 bp, Artificial sequence
  Synthetic oligonucleotide
cactctataggttcaagcag

SEQ ID NO: 1220 - DNA, 20 bp, Artificial sequence
  Synthetic oligonucleotide
ccagggtaggattcatggtc

SEQ ID NO: 1221 - DNA, 20 bp, Artificial sequence
  Synthetic oligonucleotide
tgttgtatgcaggttcatca

SEQ ID NO: 1222 - DNA, 20 bp, Artificial sequence
  Synthetic oligonucleotide
gatacattgtcctcctggta

SEQ ID NO: 1223 - DNA, 20 bp, Artificial sequence
  Synthetic oligonucleotide
acacttgaagctgttgagtc

SEQ ID NO: 1224 - DNA, 20 bp, Artificial sequence
  Synthetic oligonucleotide
cgtgaaggaatgatctctct

SEQ ID NO: 1225 - DNA, 20 bp, Artificial sequence
  Synthetic oligonucleotide
cctaatctatgctgggcccc

SEQ ID NO: 1226 - DNA, 20 bp, Artificial sequence
  Synthetic oligonucleotide
gagagtaagttactagaggc

SEQ ID NO: 1227 - DNA, 20 bp, Artificial sequence
  Synthetic oligonucleotide
tgggcagattgatcacctag

SEQ ID NO: 1228 - DNA, 20 bp, Artificial sequence
  Synthetic oligonucleotide
tactaggcctgctctactgg

SEQ ID NO: 1229 - DNA, 20 bp, Artificial sequence
  Synthetic oligonucleotide
ttagaggtcaagccctgtgt

SEQ ID NO: 1230 - DNA, 20 bp, Artificial sequence
  Synthetic oligonucleotide
gggtcggatatagcttttac

SEQ ID NO: 1231 - DNA, 20 bp, Artificial sequence
  Synthetic oligonucleotide
gcttatgtagctcagctcaa

SEQ ID NO: 1232 - DNA, 20 bp, Artificial sequence
  Synthetic oligonucleotide
ttgggacatcccaaagttac

SEQ ID NO: 1233 - DNA, 20 bp, Artificial sequence
  Synthetic oligonucleotide
ggaacatcatgttagccatc

SEQ ID NO: 1234 - DNA, 20 bp, Artificial sequence
  Synthetic oligonucleotide
gatgcatcaagccaatgcgc

SEQ ID NO: 1235 - DNA, 20 bp, Artificial sequence
  Synthetic oligonucleotide
gaacctctacagagagacta

SEQ ID NO: 1236 - DNA, 20 bp, Artificial sequence
  Synthetic oligonucleotide
gttctgtatacaccatccca

SEQ ID NO: 1237 - DNA, 20 bp, Artificial sequence
  Synthetic oligonucleotide
gcaaaatgtgggtctgcacc

SEQ ID NO: 1238 - DNA, 20 bp, Artificial sequence
  Synthetic oligonucleotide
taactggtgaactcctgtga

SEQ ID NO: 1239 - DNA, 20 bp, Artificial sequence
  Synthetic oligonucleotide
ccccagaagtggagtaggta

SEQ ID NO: 1240 - DNA, 20 bp, Artificial sequence
  Synthetic oligonucleotide
cctcaagatcaacagacccc

SEQ ID NO: 1241 - DNA, 20 bp, Artificial sequence
  Synthetic oligonucleotide
cagtcaggtacaggtgttgg

SEQ ID NO: 1242 - DNA, 20 bp, Artificial sequence
  Synthetic oligonucleotide
gtgagggtgcttagtgaact

SEQ ID NO: 1243 - DNA, 20 bp, Artificial sequence
  Synthetic oligonucleotide
gtcagaacaatccggcatgc

SEQ ID NO: 1244 - DNA, 20 bp, Artificial sequence
  Synthetic oligonucleotide
gagtgctccacacttctgtc

SEQ ID NO: 1245 - DNA, 20 bp, Artificial sequence
  Synthetic oligonucleotide
gcttgcagtgctactgtgcc

SEQ ID NO: 1246 - DNA, 20 bp, Artificial sequence
  Synthetic oligonucleotide
tcgatacctgcttttgtgac

SEQ ID NO: 1247 - DNA, 20 bp, Artificial sequence
  Synthetic oligonucleotide
cataaccgaagtggaagtag

SEQ ID NO: 1248 - DNA, 20 bp, Artificial sequence
  Synthetic oligonucleotide
tacttcatgactgcctagtt

SEQ ID NO: 1249 - DNA, 20 bp, Artificial sequence
  Synthetic oligonucleotide
aagaagggcatatatctacg

SEQ ID NO: 1250 - DNA, 20 bp, Artificial sequence
  Synthetic oligonucleotide
cggacagtgttgctgttagg

SEQ ID NO: 1251 - DNA, 20 bp, Artificial sequence
  Synthetic oligonucleotide
ggtcaagccgaatcttgaca

SEQ ID NO: 1252 - DNA, 20 bp, Artificial sequence
  Synthetic oligonucleotide
tgactgggtaaggcaggatc

SEQ ID NO: 1253 - DNA, 20 bp, Artificial sequence
  Synthetic oligonucleotide
agtactcctaccaataatgg

SEQ ID NO: 1254 - DNA, 20 bp, Artificial sequence
  Synthetic oligonucleotide
ggcagtgcattcaactgtag

SEQ ID NO: 1255 - DNA, 20 bp, Artificial sequence
  Synthetic oligonucleotide
cgtgggttagtccaagtaac

SEQ ID NO: 1256 - DNA, 20 bp, Artificial sequence
  Synthetic oligonucleotide
gcccattatgtagtctatag

SEQ ID NO: 1257 - DNA, 20 bp, Artificial sequence
  Synthetic oligonucleotide
gacgaaggcagtcactctgc

SEQ ID NO: 1258 - DNA, 20 bp, Artificial sequence
  Synthetic oligonucleotide
gggagaactacatctcacct

SEQ ID NO: 1259 - DNA, 20 bp, Artificial sequence
  Synthetic oligonucleotide
ccccattaccacggtctctt

SEQ ID NO: 1260 - DNA, 20 bp, Artificial sequence
  Synthetic oligonucleotide
agcagtctttatctacaggc

SEQ ID NO: 1261 - DNA, 20 bp, Artificial sequence
  Synthetic oligonucleotide
ttgatgacctggtaagggat

SEQ ID NO: 1262 - DNA, 20 bp, Artificial sequence
  Synthetic oligonucleotide
cgcaataagattccattgcc

SEQ ID NO: 1263 - DNA, 20 bp, Artificial sequence
  Synthetic oligonucleotide
acgataactgtagcgcattg

SEQ ID NO: 1264 - DNA, 20 bp, Artificial sequence
  Synthetic oligonucleotide
gcaagtatgctagtcactca

SEQ ID NO: 1265 - DNA, 20 bp, Artificial sequence
  Synthetic oligonucleotide
ccattagataggctataggc

SEQ ID NO: 1266 - DNA, 20 bp, Artificial sequence
  Synthetic oligonucleotide
tcgccgctgattttaaagat

SEQ ID NO: 1267 - DNA, 20 bp, Artificial sequence
  Synthetic oligonucleotide
ggttcaaaagccggtgcagg

SEQ ID NO: 1268 - DNA, 20 bp, Artificial sequence
  Synthetic oligonucleotide
gttgttcttaagtgcccatg

SEQ ID NO: 1269 - DNA, 20 bp, Artificial sequence
  Synthetic oligonucleotide
gcactttgcatgagaatagg

SEQ ID NO: 1270 - DNA, 20 bp, Artificial sequence
  Synthetic oligonucleotide
tccagacaagtctactacca

SEQ ID NO: 1271 - DNA, 20 bp, Artificial sequence
  Synthetic oligonucleotide
tctactccttgctacaaacg

SEQ ID NO: 1272 - DNA, 20 bp, Artificial sequence
  Synthetic oligonucleotide
gggatccccaaatagagcca

SEQ ID NO: 1273 - DNA, 20 bp, Artificial sequence
  Synthetic oligonucleotide
caatagtgtaggtgacatgg

SEQ ID NO: 1274 - DNA, 20 bp, Artificial sequence
  Synthetic oligonucleotide
gcatgtgggcctctattaag

SEQ ID NO: 1275 - DNA, 20 bp, Artificial sequence
  Synthetic oligonucleotide
gtatggtatcttgcagtagc

SEQ ID NO: 1276 - DNA, 20 bp, Artificial sequence
  Synthetic oligonucleotide
atagccctttcagcacactt

SEQ ID NO: 1277 - DNA, 20 bp, Artificial sequence
  Synthetic oligonucleotide
gctggcaatatgtcaacctt

SEQ ID NO: 1278 - DNA, 20 bp, Artificial sequence
  Synthetic oligonucleotide
tgtacaaacgggctatgtga

SEQ ID NO: 1279 - DNA, 20 bp, Artificial sequence
  Synthetic oligonucleotide
catatgaagctataggtacc

SEQ ID NO: 1280 - DNA, 20 bp, Artificial sequence
  Synthetic oligonucleotide
ggtagttcacaactcttcct

SEQ ID NO: 1281 - DNA, 20 bp, Artificial sequence
  Synthetic oligonucleotide
tctgcgaatagaggccctct

SEQ ID NO: 1282 - DNA, 20 bp, Artificial sequence
  Synthetic oligonucleotide
gacacgctgactatgatgtg

SEQ ID NO: 1283 - DNA, 20 bp, Artificial sequence
  Synthetic oligonucleotide
cttgcccatggatggttgtc

SEQ ID NO: 1284 - DNA, 20 bp, Artificial sequence
  Synthetic oligonucleotide
gtggcttataggtgggttcc

SEQ ID NO: 1285 - DNA, 20 bp, Artificial sequence
  Synthetic oligonucleotide
ggttgtatgccttctgcatt

SEQ ID NO: 1286 - DNA, 20 bp, Artificial sequence
  Synthetic oligonucleotide
ccttgcagcacttgtatagt

SEQ ID NO: 1287 - DNA, 20 bp, Artificial sequence
  Synthetic oligonucleotide
actatcctgcatccgaggca

SEQ ID NO: 1288 - DNA, 20 bp, Artificial sequence
  Synthetic oligonucleotide
atataattgagggccaccat

SEQ ID NO: 1289 - DNA, 20 bp, Artificial sequence
  Synthetic oligonucleotide
cctttagagggatttgtgta

SEQ ID NO: 1290 - DNA, 20 bp, Artificial sequence
  Synthetic oligonucleotide
cttaacatgttcatacgagt

SEQ ID NO: 1291 - DNA, 20 bp, Artificial sequence
  Synthetic oligonucleotide
gctgatcacattacccatcc

SEQ ID NO: 1292 - DNA, 20 bp, Artificial sequence
  Synthetic oligonucleotide
gatgtatcacgcaaacaatt

SEQ ID NO: 1293 - DNA, 20 bp, Artificial sequence
  Synthetic oligonucleotide
accaaggagttacaagtgtc

SEQ ID NO: 1294 - DNA, 20 bp, Artificial sequence
  Synthetic oligonucleotide
ggccaggatggtcaacctta

SEQ ID NO: 1295 - DNA, 20 bp, Artificial sequence
  Synthetic oligonucleotide
tttttgccacagccgcttgg

SEQ ID NO: 1296 - DNA, 20 bp, Artificial sequence
  Synthetic oligonucleotide
cgaataattgcatgccaact

SEQ ID NO: 1297 - DNA, 20 bp, Artificial sequence
  Synthetic oligonucleotide
ggtttagtgtcatatgtagc

SEQ ID NO: 1298 - DNA, 20 bp, Artificial sequence
  Synthetic oligonucleotide
gcacacacctgtataggaga

SEQ ID NO: 1299 - DNA, 20 bp, Artificial sequence
  Synthetic oligonucleotide
cctgccactcccgtggcaac

SEQ ID NO: 1300 - DNA, 20 bp, Artificial sequence
  Synthetic oligonucleotide
ttatgggtaagaggtcggtc

SEQ ID NO: 1301 - DNA, 20 bp, Artificial sequence
  Synthetic oligonucleotide
ggtatggaggccatgtacga

SEQ ID NO: 1302 - DNA, 20 bp, Artificial sequence
  Synthetic oligonucleotide
gcgcccggcaagagattcac

SEQ ID NO: 1303 - DNA, 20 bp, Artificial sequence
  Synthetic oligonucleotide
ttgcataataggaggtcctt

SEQ ID NO: 1304 - DNA, 20 bp, Artificial sequence
  Synthetic oligonucleotide
gggcttacaacctctcaatt

SEQ ID NO: 1305 - DNA, 20 bp, Artificial sequence
  Synthetic oligonucleotide
cctaactggcctttgggtcg

SEQ ID NO: 1306 - DNA, 20 bp, Artificial sequence
  Synthetic oligonucleotide
gtctgcacaggtggcataga

SEQ ID NO: 1307 - DNA, 20 bp, Artificial sequence
  Synthetic oligonucleotide
gtccagaggtcatatggccc

SEQ ID NO: 1308 - DNA, 20 bp, Artificial sequence
  Synthetic oligonucleotide
gcataagtaaggcatggtct

SEQ ID NO: 1309 - DNA, 20 bp, Artificial sequence
  Synthetic oligonucleotide
cttcgggcaaatatggcccg

SEQ ID NO: 1310 - DNA, 20 bp, Artificial sequence
  Synthetic oligonucleotide
ggtgctacagtcatactatc

SEQ ID NO: 1311 - DNA, 20 bp, Artificial sequence
  Synthetic oligonucleotide
gtgatcagctcaacaccccc

SEQ ID NO: 1312 - DNA, 20 bp, Artificial sequence
  Synthetic oligonucleotide
taataaagggtcagttgtgc

SEQ ID NO: 1313 - DNA, 20 bp, Artificial sequence
  Synthetic oligonucleotide
cactgcctaagcaaggaatc

SEQ ID NO: 1314 - DNA, 20 bp, Artificial sequence
  Synthetic oligonucleotide
tgccccaaagatttaggcca

SEQ ID NO: 1315 - DNA, 20 bp, Artificial sequence
  Synthetic oligonucleotide
tcagacatggtaaccttcac

SEQ ID NO: 1316 - DNA, 20 bp, Artificial sequence
  Synthetic oligonucleotide
attgcaggcctagcttccac

SEQ ID NO: 1317 - DNA, 20 bp, Artificial sequence
  Synthetic oligonucleotide
ggtattgagtaggacttctc

SEQ ID NO: 1318 - DNA, 20 bp, Artificial sequence
  Synthetic oligonucleotide
cttaaggaggcaactcctga

SEQ ID NO: 1319 - DNA, 20 bp, Artificial sequence
  Synthetic oligonucleotide
atatactccaggttgtggag

SEQ ID NO: 1320 - DNA, 20 bp, Artificial sequence
  Synthetic oligonucleotide
gagccaggttcctgttcacg

SEQ ID NO: 1321 - DNA, 20 bp, Artificial sequence
  Synthetic oligonucleotide
ccgtctttaggaacttaaat

SEQ ID NO: 1322 - DNA, 20 bp, Artificial sequence
  Synthetic oligonucleotide
agcacaacccccgtgctgct

SEQ ID NO: 1323 - DNA, 20 bp, Artificial sequence
  Synthetic oligonucleotide
tacccaacatgcttgcatcc

SEQ ID NO: 1324 - DNA, 20 bp, Artificial sequence
  Synthetic oligonucleotide
atacacggaacccacagtag

SEQ ID NO: 1325 - DNA, 20 bp, Artificial sequence
  Synthetic oligonucleotide
catgctagggactctgattg

SEQ ID NO: 1326 - DNA, 20 bp, Artificial sequence
  Synthetic oligonucleotide
gttagaccaggcataagtac

SEQ ID NO: 1327 - DNA, 20 bp, Artificial sequence
  Synthetic oligonucleotide
tgcagctgagtgccatataa

SEQ ID NO: 1328 - DNA, 20 bp, Artificial sequence
  Synthetic oligonucleotide
actacttggagaccttcacc

SEQ ID NO: 1329 - DNA, 20 bp, Artificial sequence
  Synthetic oligonucleotide
gctcctgacaaattagcact

SEQ ID NO: 1330 - DNA, 20 bp, Artificial sequence
  Synthetic oligonucleotide
cggatgcagggcacccttgg

SEQ ID NO: 1331 - DNA, 20 bp, Artificial sequence
  Synthetic oligonucleotide
catgatataaggagaaacgc

SEQ ID NO: 1332 - DNA, 20 bp, Artificial sequence
  Synthetic oligonucleotide
atcttgcggctgtctcccag

SEQ ID NO: 1333 - DNA, 20 bp, Artificial sequence
  Synthetic oligonucleotide
tcccatagttatatggctca

SEQ ID NO: 1334 - DNA, 20 bp, Artificial sequence
  Synthetic oligonucleotide
ctgcatgttagattgggcat

SEQ ID NO: 1335 - DNA, 20 bp, Artificial sequence
  Synthetic oligonucleotide
gctgtgatgctaggatgcat

SEQ ID NO: 1336 - DNA, 20 bp, Artificial sequence
  Synthetic oligonucleotide
agacatagaccccagacggt

SEQ ID NO: 1337 - DNA, 20 bp, Artificial sequence
  Synthetic oligonucleotide
cccttaccagaatagcatcc

SEQ ID NO: 1338 - DNA, 20 bp, Artificial sequence
  Synthetic oligonucleotide
tggtagaccactgattcccc

SEQ ID NO: 1339 - DNA, 20 bp, Artificial sequence
  Synthetic oligonucleotide
agcaagggtcttagtgccaa

SEQ ID NO: 1340 - DNA, 20 bp, Artificial sequence
  Synthetic oligonucleotide
gtctgtatatttagaccacg

SEQ ID NO: 1341 - DNA, 20 bp, Artificial sequence
  Synthetic oligonucleotide
gtcaacattatatcgatgca

SEQ ID NO: 1342 - DNA, 20 bp, Artificial sequence
  Synthetic oligonucleotide
gtatggcttatgcatgctat

SEQ ID NO: 1343 - DNA, 20 bp, Artificial sequence
  Synthetic oligonucleotide
tgggcaggtcaacttggtat

SEQ ID NO: 1344 - DNA, 20 bp, Artificial sequence
  Synthetic oligonucleotide
aaaaggtgattaggcggccg

SEQ ID NO: 1345 - DNA, 20 bp, Artificial sequence
  Synthetic oligonucleotide
tgacccttatggagacttat

SEQ ID NO: 1346 - DNA, 20 bp, Artificial sequence
  Synthetic oligonucleotide
tccagggtagaagactagca

SEQ ID NO: 1347 - DNA, 20 bp, Artificial sequence
  Synthetic oligonucleotide
gcaatagaacagatggccat

SEQ ID NO: 1348 - DNA, 20 bp, Artificial sequence
  Synthetic oligonucleotide
gtaccaaagtggctgctcac

SEQ ID NO: 1349 - DNA, 20 bp, Artificial sequence
  Synthetic oligonucleotide
actgccctcttcgaagagat

SEQ ID NO: 1350 - DNA, 20 bp, Artificial sequence
  Synthetic oligonucleotide
gattatctcagacatgccat

SEQ ID NO: 1351 - DNA, 20 bp, Artificial sequence
  Synthetic oligonucleotide
ccttaagcaaggagttcact

SEQ ID NO: 1352 - DNA, 20 bp, Artificial sequence
  Synthetic oligonucleotide
atcctggtatgactgtcagt

SEQ ID NO: 1353 - DNA, 20 bp, Artificial sequence
  Synthetic oligonucleotide
ggctctcatctaaataagcc

SEQ ID NO: 1354 - DNA, 20 bp, Artificial sequence
  Synthetic oligonucleotide
aaccctaaggtgaagtctgt

SEQ ID NO: 1355 - DNA, 20 bp, Artificial sequence
  Synthetic oligonucleotide
gggtattgctgtccaaatgg

SEQ ID NO: 1356 - DNA, 20 bp, Artificial sequence
  Synthetic oligonucleotide
gtgttatggttcccattcag

SEQ ID NO: 1357 - DNA, 20 bp, Artificial sequence
  Synthetic oligonucleotide
cctgctcaaatctgcgaata

SEQ ID NO: 1358 - DNA, 20 bp, Artificial sequence
  Synthetic oligonucleotide
gacttattgaggatggtgtg

SEQ ID NO: 1359 - DNA, 20 bp, Artificial sequence
  Synthetic oligonucleotide
tgaactcccacaaggtactc

SEQ ID NO: 1360 - DNA, 20 bp, Artificial sequence
  Synthetic oligonucleotide
aggcatttggagcattcggg

SEQ ID NO: 1361 - DNA, 20 bp, Artificial sequence
  Synthetic oligonucleotide
actttcatcagttagtcagg

SEQ ID NO: 1362 - DNA, 20 bp, Artificial sequence
  Synthetic oligonucleotide
cattgacaagctattgcagc

SEQ ID NO: 1363 - DNA, 20 bp, Artificial sequence
  Synthetic oligonucleotide
ttttatggcttatagcagcg

SEQ ID NO: 1364 - DNA, 20 bp, Artificial sequence
  Synthetic oligonucleotide
cacgcccaaatggaactcta

SEQ ID NO: 1365 - DNA, 20 bp, Artificial sequence
  Synthetic oligonucleotide
gtgagttatagagtgttccc

SEQ ID NO: 1366 - DNA, 20 bp, Artificial sequence
  Synthetic oligonucleotide
tgggcacttaggagttccta

SEQ ID NO: 1367 - DNA, 20 bp, Artificial sequence
  Synthetic oligonucleotide
gctgtatctgtggtttagca

SEQ ID NO: 1368 - DNA, 20 bp, Artificial sequence
  Synthetic oligonucleotide
gcggatgccagtggccgaga

SEQ ID NO: 1369 - DNA, 20 bp, Artificial sequence
  Synthetic oligonucleotide
gctatacccctaggatcaga

SEQ ID NO: 1370 - DNA, 20 bp, Artificial sequence
  Synthetic oligonucleotide
taggcattgaatgagggccc

SEQ ID NO: 1371 - DNA, 20 bp, Artificial sequence
  Synthetic oligonucleotide
gtatggacttgtcttatggc

SEQ ID NO: 1372 - DNA, 20 bp, Artificial sequence
  Synthetic oligonucleotide
aatagactgcgattatacaa

SEQ ID NO: 1373 - DNA, 20 bp, Artificial sequence
  Synthetic oligonucleotide
cgcaattgaacttaaattgg

SEQ ID NO: 1374 - DNA, 20 bp, Artificial sequence
  Synthetic oligonucleotide
ggaccacctaagacctcaag

SEQ ID NO: 1375 - DNA, 20 bp, Artificial sequence
  Synthetic oligonucleotide
ggctaaagtaatcttatggg

SEQ ID NO: 1376 - DNA, 20 bp, Artificial sequence
  Synthetic oligonucleotide
gtgcaatagcctaaatgcca

SEQ ID NO: 1377 - DNA, 20 bp, Artificial sequence
  Synthetic oligonucleotide
ggattaggcagcttcactac

SEQ ID NO: 1378 - DNA, 20 bp, Artificial sequence
  Synthetic oligonucleotide
gcaaatacaatggtaatcgc

SEQ ID NO: 1379 - DNA, 20 bp, Artificial sequence
  Synthetic oligonucleotide
ctggtgtacattggatatga

SEQ ID NO: 1380 - DNA, 20 bp, Artificial sequence
  Synthetic oligonucleotide
gcaagaggtactgtaagccc

SEQ ID NO: 1381 - DNA, 20 bp, Artificial sequence
  Synthetic oligonucleotide
atccgatagtcaaactatga

SEQ ID NO: 1382 - DNA, 20 bp, Artificial sequence
  Synthetic oligonucleotide
aaacacccttccaatgaggg

SEQ ID NO: 1383 - DNA, 20 bp, Artificial sequence
  Synthetic oligonucleotide
gttcactagcatctgctaca

SEQ ID NO: 1384 - DNA, 20 bp, Artificial sequence
  Synthetic oligonucleotide
gctctttgtaggcccaaggg

SEQ ID NO: 1385 - DNA, 20 bp, Artificial sequence
  Synthetic oligonucleotide
ggttcctataaggaataggc

SEQ ID NO: 1386 - DNA, 20 bp, Artificial sequence
  Synthetic oligonucleotide
taataggcctttctacagct

SEQ ID NO: 1387 - DNA, 20 bp, Artificial sequence
  Synthetic oligonucleotide
ccccagggtcataggagtgt

SEQ ID NO: 1388 - DNA, 20 bp, Artificial sequence
  Synthetic oligonucleotide
ccaccaaccttaaatagtag

SEQ ID NO: 1389 - DNA, 20 bp, Artificial sequence
  Synthetic oligonucleotide
ccacagattggcttggaatg

SEQ ID NO: 1390 - DNA, 20 bp, Artificial sequence
  Synthetic oligonucleotide
gccttacgcttggctgacat

SEQ ID NO: 1391 - DNA, 20 bp, Artificial sequence
  Synthetic oligonucleotide
gtctctgtgtaccgagctca

SEQ ID NO: 1392 - DNA, 20 bp, Artificial sequence
  Synthetic oligonucleotide
gtctggtggccaagtgcttc

SEQ ID NO: 1393 - DNA, 20 bp, Artificial sequence
  Synthetic oligonucleotide
agccgagcattggcttcata

SEQ ID NO: 1394 - DNA, 20 bp, Artificial sequence
  Synthetic oligonucleotide
ggtggtggaatgctgtccac

SEQ ID NO: 1395 - DNA, 20 bp, Artificial sequence
  Synthetic oligonucleotide
ctccaccaaatacttagccc

SEQ ID NO: 1396 - DNA, 20 bp, Artificial sequence
  Synthetic oligonucleotide
taaatgtcaggaggtccccc

SEQ ID NO: 1397 - DNA, 20 bp, Artificial sequence
  Synthetic oligonucleotide
ccttgggttattcttaccgt

SEQ ID NO: 1398 - DNA, 20 bp, Artificial sequence
  Synthetic oligonucleotide
ggtagtataagaatggttcc

SEQ ID NO: 1399 - DNA, 20 bp, Artificial sequence
  Synthetic oligonucleotide
atacacttgggcccaaatgg

SEQ ID NO: 1400 - DNA, 20 bp, Artificial sequence
  Synthetic oligonucleotide
gctagcatttgagagttata

SEQ ID NO: 1401 - DNA, 20 bp, Artificial sequence
  Synthetic oligonucleotide
ggctgtaagggattaagatg

SEQ ID NO: 1402 - DNA, 20 bp, Artificial sequence
  Synthetic oligonucleotide
ctgttacagggagacaatct

SEQ ID NO: 1403 - DNA, 20 bp, Artificial sequence
  Synthetic oligonucleotide
accctgcacaaatggactgc

SEQ ID NO: 1404 - DNA, 20 bp, Artificial sequence
  Synthetic oligonucleotide
gggcacccccgtcaccgtgc

SEQ ID NO: 1405 - DNA, 20 bp, Artificial sequence
  Synthetic oligonucleotide
agattttccgacctatgtca

SEQ ID NO: 1406 - DNA, 20 bp, Artificial sequence
  Synthetic oligonucleotide
atcgccatggtcacttgcca

SEQ ID NO: 1407 - DNA, 20 bp, Artificial sequence
  Synthetic oligonucleotide
ggcaaagcaagttcgccaca

SEQ ID NO: 1408 - DNA, 20 bp, Artificial sequence
  Synthetic oligonucleotide
atcatacaggtcacttggct

SEQ ID NO: 1409 - DNA, 20 bp, Artificial sequence
  Synthetic oligonucleotide
attggactaggtaacagtga

SEQ ID NO: 1410 - DNA, 20 bp, Artificial sequence
  Synthetic oligonucleotide
caggctatttcttagtggac

SEQ ID NO: 1411 - DNA, 20 bp, Artificial sequence
  Synthetic oligonucleotide
caagggtaacctatagctga

SEQ ID NO: 1412 - DNA, 20 bp, Artificial sequence
  Synthetic oligonucleotide
gcatatgcacacttggatca

SEQ ID NO: 1413 - DNA, 20 bp, Artificial sequence
  Synthetic oligonucleotide
accctgaaaacaatcaatcg

SEQ ID NO: 1414 - DNA, 20 bp, Artificial sequence
  Synthetic oligonucleotide
acgataatcatgtggcctga

SEQ ID NO: 1415 - DNA, 20 bp, Artificial sequence
  Synthetic oligonucleotide
gactaactatacaggtctct

SEQ ID NO: 1416 - DNA, 20 bp, Artificial sequence
  Synthetic oligonucleotide
actacctaggctcacttgct

SEQ ID NO: 1417 - DNA, 20 bp, Artificial sequence
  Synthetic oligonucleotide
ccaggatgctaatgctccta

SEQ ID NO: 1418 - DNA, 20 bp, Artificial sequence
  Synthetic oligonucleotide
gcgctttcaccaagaaattt

SEQ ID NO: 1419 - DNA, 20 bp, Artificial sequence
  Synthetic oligonucleotide
gcaaagactacaccgtgaca

SEQ ID NO: 1420 - DNA, 20 bp, Artificial sequence
  Synthetic oligonucleotide
cccctgcattcagcttatag

SEQ ID NO: 1421 - DNA, 20 bp, Artificial sequence
  Synthetic oligonucleotide
gctatccaagtgacacagta

SEQ ID NO: 1422 - DNA, 20 bp, Artificial sequence
  Synthetic oligonucleotide
gggccgcacatctggacctc

SEQ ID NO: 1423 - DNA, 20 bp, Artificial sequence
  Synthetic oligonucleotide
tacaaaacgacctaaagacc

SEQ ID NO: 1424 - DNA, 20 bp, Artificial sequence
  Synthetic oligonucleotide
ctgcaatccttaagacttga

SEQ ID NO: 1425 - DNA, 20 bp, Artificial sequence
  Synthetic oligonucleotide
cctcaagacctataggacct

SEQ ID NO: 1426 - DNA, 20 bp, Artificial sequence
  Synthetic oligonucleotide
atacattgccagcactaagg

SEQ ID NO: 1427 - DNA, 20 bp, Artificial sequence
  Synthetic oligonucleotide
gatttaccacacatataggc

SEQ ID NO: 1428 - DNA, 20 bp, Artificial sequence
  Synthetic oligonucleotide
cgggctatgtgagataattc

SEQ ID NO: 1429 - DNA, 20 bp, Artificial sequence
  Synthetic oligonucleotide
ggctgacatgccccttttaa

SEQ ID NO: 1430 - DNA, 20 bp, Artificial sequence
  Synthetic oligonucleotide
gttgtgatagtcaacaattg

SEQ ID NO: 1431 - DNA, 20 bp, Artificial sequence
  Synthetic oligonucleotide
aggccctcttgtttcaattg

SEQ ID NO: 1432 - DNA, 20 bp, Artificial sequence
  Synthetic oligonucleotide
gattttattggtcatctcgg

SEQ ID NO: 1433 - DNA, 20 bp, Artificial sequence
  Synthetic oligonucleotide
gcctttctatttcagaccga

SEQ ID NO: 1434 - DNA, 20 bp, Artificial sequence
  Synthetic oligonucleotide
ggagtccatgaagtaactgg

SEQ ID NO: 1435 - DNA, 20 bp, Artificial sequence
  Synthetic oligonucleotide
aggttgcataaagccaggcc

SEQ ID NO: 1436 - DNA, 20 bp, Artificial sequence
  Synthetic oligonucleotide
ccctcttagtgattggtggt

SEQ ID NO: 1437 - DNA, 20 bp, Artificial sequence
  Synthetic oligonucleotide
ggttggcagtcttcaccagt

SEQ ID NO: 1438 - DNA, 20 bp, Artificial sequence
  Synthetic oligonucleotide
gcttgaatggataccaatta

SEQ ID NO: 1439 - DNA, 20 bp, Artificial sequence
  Synthetic oligonucleotide
ctcggtcaaactaataatac

SEQ ID NO: 1440 - DNA, 20 bp, Artificial sequence
  Synthetic oligonucleotide
ccagttttcgcccgttacct

SEQ ID NO: 1441 - DNA, 20 bp, Artificial sequence
  Synthetic oligonucleotide
gtagctataggtgtcacata

SEQ ID NO: 1442 - DNA, 20 bp, Artificial sequence
  Synthetic oligonucleotide
gcctcaaatatgtgatgcac

SEQ ID NO: 1443 - DNA, 20 bp, Artificial sequence
  Synthetic oligonucleotide
gaatggcaatacatccgtgt

SEQ ID NO: 1444 - DNA, 20 bp, Artificial sequence
  Synthetic oligonucleotide
tcaatggacccacatgatca

SEQ ID NO: 1445 - DNA, 20 bp, Artificial sequence
  Synthetic oligonucleotide
tgcatacccagggtaggatt

SEQ ID NO: 1446 - DNA, 20 bp, Artificial sequence
  Synthetic oligonucleotide
tctaatactacaacgatgga

SEQ ID NO: 1447 - DNA, 20 bp, Artificial sequence
  Synthetic oligonucleotide
aaccttcctaaaatccccga

SEQ ID NO: 1448 - DNA, 20 bp, Artificial sequence
  Synthetic oligonucleotide
gatatacccagttaatcagt

SEQ ID NO: 1449 - DNA, 20 bp, Artificial sequence
  Synthetic oligonucleotide
ttggcagatgtaacctattc

SEQ ID NO: 1450 - DNA, 20 bp, Artificial sequence
  Synthetic oligonucleotide
cgaccctcatcactttttga

SEQ ID NO: 1451 - DNA, 20 bp, Artificial sequence
  Synthetic oligonucleotide
acgggacctcaatactctac

SEQ ID NO: 1452 - DNA, 20 bp, Artificial sequence
  Synthetic oligonucleotide
attcaaggtagccccaatac

SEQ ID NO: 1453 - DNA, 20 bp, Artificial sequence
  Synthetic oligonucleotide
ctggcctttgggtcggatat

SEQ ID NO: 1454 - DNA, 20 bp, Artificial sequence
  Synthetic oligonucleotide
ccccagataatgcatagatc

SEQ ID NO: 1455 - DNA, 20 bp, Artificial sequence
  Synthetic oligonucleotide
gggctaagagtcacctgtat

SEQ ID NO: 1456 - DNA, 20 bp, Artificial sequence
  Synthetic oligonucleotide
cccttggccacctgacttcg

SEQ ID NO: 1457 - DNA, 20 bp, Artificial sequence
  Synthetic oligonucleotide
ttggctcagtgttcacttcg

SEQ ID NO: 1458 - DNA, 20 bp, Artificial sequence
  Synthetic oligonucleotide
gtaaccagacccaaggcact

SEQ ID NO: 1459 - DNA, 20 bp, Artificial sequence
  Synthetic oligonucleotide
gagatccatgaggtatatac

SEQ ID NO: 1460 - DNA, 20 bp, Artificial sequence
  Synthetic oligonucleotide
gcccagtgccctataggtca

SEQ ID NO: 1461 - DNA, 20 bp, Artificial sequence
  Synthetic oligonucleotide
gctatttcattaagtcaccc

SEQ ID NO: 1462 - DNA, 20 bp, Artificial sequence
  Synthetic oligonucleotide
ccatggaatggctgtcatgc

SEQ ID NO: 1463 - DNA, 20 bp, Artificial sequence
  Synthetic oligonucleotide
ttatcttcttagggtcgact

SEQ ID NO: 1464 - DNA, 20 bp, Artificial sequence
  Synthetic oligonucleotide
agctatccgcttcccaaggg

SEQ ID NO: 1465 - DNA, 20 bp, Artificial sequence
  Synthetic oligonucleotide
ccctgagatgctagttgggc

SEQ ID NO: 1466 - DNA, 20 bp, Artificial sequence
  Synthetic oligonucleotide
gtatgtccttggaggtgagc

SEQ ID NO: 1467 - DNA, 20 bp, Artificial sequence
  Synthetic oligonucleotide
gcctttcattttgggagtgc

SEQ ID NO: 1468 - DNA, 20 bp, Artificial sequence
  Synthetic oligonucleotide
ggcatggagatccaacctgt

SEQ ID NO: 1469 - DNA, 20 bp, Artificial sequence
  Synthetic oligonucleotide
ggcactgcaggatagccatt

SEQ ID NO: 1470 - DNA, 20 bp, Artificial sequence
  Synthetic oligonucleotide
cgttatcctaagaagtgact

SEQ ID NO: 1471 - DNA, 20 bp, Artificial sequence
  Synthetic oligonucleotide
tcaacatgtgttaacggaac

SEQ ID NO: 1472 - DNA, 20 bp, Artificial sequence
  Synthetic oligonucleotide
gtacctgcagtgcatagagc

SEQ ID NO: 1473 - DNA, 20 bp, Artificial sequence
  Synthetic oligonucleotide
gattgattcagtgctcatgc

SEQ ID NO: 1474 - DNA, 20 bp, Artificial sequence
  Synthetic oligonucleotide
actgcagataggtaggtgat

SEQ ID NO: 1475 - DNA, 20 bp, Artificial sequence
  Synthetic oligonucleotide
gttggaagctgccagcttag

SEQ ID NO: 1476 - DNA, 20 bp, Artificial sequence
  Synthetic oligonucleotide
actggcctgtggcagttaac

SEQ ID NO: 1477 - DNA, 20 bp, Artificial sequence
  Synthetic oligonucleotide
gcgctggctcacgcatgctc

SEQ ID NO: 1478 - DNA, 20 bp, Artificial sequence
  Synthetic oligonucleotide
cctagagtttccttctcccg

SEQ ID NO: 1479 - DNA, 20 bp, Artificial sequence
  Synthetic oligonucleotide
gggatgccaatgcctccaac

SEQ ID NO: 1480 - DNA, 20 bp, Artificial sequence
  Synthetic oligonucleotide
taaattgccctgggtgcagc

SEQ ID NO: 1481 - DNA, 20 bp, Artificial sequence
  Synthetic oligonucleotide
gccctttcaggaccaactgg

SEQ ID NO: 1482 - DNA, 20 bp, Artificial sequence
  Synthetic oligonucleotide
gttgggcaaacaagttaccc

SEQ ID NO: 1483 - DNA, 20 bp, Artificial sequence
  Synthetic oligonucleotide
gggaccccaatttactacgc

SEQ ID NO: 1484 - DNA, 20 bp, Artificial sequence
  Synthetic oligonucleotide
cttcttgcaaggattggcac

SEQ ID NO: 1485 - DNA, 20 bp, Artificial sequence
  Synthetic oligonucleotide
actgagatgtgtgatactcc

SEQ ID NO: 1486 - DNA, 20 bp, Artificial sequence
  Synthetic oligonucleotide
ccactcaatagaatagtgcc

SEQ ID NO: 1487 - DNA, 20 bp, Artificial sequence
  Synthetic oligonucleotide
cccaattgcaaggaccctta

SEQ ID NO: 1488 - DNA, 20 bp, Artificial sequence
  Synthetic oligonucleotide
gaacatgtagccataatgcc

SEQ ID NO: 1489 - DNA, 20 bp, Artificial sequence
  Synthetic oligonucleotide
gagtggcatccttaaatcct

SEQ ID NO: 1490 - DNA, 20 bp, Artificial sequence
  Synthetic oligonucleotide
taattggtcaagtaaacagc

SEQ ID NO: 1491 - DNA, 20 bp, Artificial sequence
  Synthetic oligonucleotide
tccaccgttactgattatct

SEQ ID NO: 1492 - DNA, 20 bp, Artificial sequence
  Synthetic oligonucleotide
caagtcccaccatgttaatc

SEQ ID NO: 1493 - DNA, 20 bp, Artificial sequence
  Synthetic oligonucleotide
gttaggatctatttgacagc

SEQ ID NO: 1494 - DNA, 20 bp, Artificial sequence
  Synthetic oligonucleotide
aggcctgctccgaatgtgtt

SEQ ID NO: 1495 - DNA, 20 bp, Artificial sequence
  Synthetic oligonucleotide
gtgcatggttatctaatgca

SEQ ID NO: 1496 - DNA, 20 bp, Artificial sequence
  Synthetic oligonucleotide
ttgggtcactaggcacacta

SEQ ID NO: 1497 - DNA, 20 bp, Artificial sequence
  Synthetic oligonucleotide
tgactagttcgataagtttt

SEQ ID NO: 1498 - DNA, 20 bp, Artificial sequence
  Synthetic oligonucleotide
tgtcgagaactcaaaaggtg

SEQ ID NO: 1499 - DNA, 20 bp, Artificial sequence
  Synthetic oligonucleotide
ctgtatagtttacccaggca

SEQ ID NO: 1500 - DNA, 20 bp, Artificial sequence
  Synthetic oligonucleotide
cagagtgcattggcaactcg

SEQ ID NO: 1501 - DNA, 20 bp, Artificial sequence
  Synthetic oligonucleotide
gatcttggtaaggcagctcc

SEQ ID NO: 1502 - DNA, 20 bp, Artificial sequence
  Synthetic oligonucleotide
caatttggtcccattgtagt

SEQ ID NO: 1503 - DNA, 20 bp, Artificial sequence
  Synthetic oligonucleotide
tctatcaaggctgttattgg

SEQ ID NO: 1504 - DNA, 20 bp, Artificial sequence
  Synthetic oligonucleotide
gctcagttaggttagtgcac

SEQ ID NO: 1505 - DNA, 20 bp, Artificial sequence
  Synthetic oligonucleotide
tctagggctccagtttatgt

SEQ ID NO: 1506 - DNA, 20 bp, Artificial sequence
  Synthetic oligonucleotide
ctttggttatgtacattgcc

SEQ ID NO: 1507 - DNA, 20 bp, Artificial sequence
  Synthetic oligonucleotide
gcctgtatgtcttgagaaac

SEQ ID NO: 1508 - DNA, 20 bp, Artificial sequence
  Synthetic oligonucleotide
ctcgcttttcacaggagcgc

SEQ ID NO: 1509 - DNA, 20 bp, Artificial sequence
  Synthetic oligonucleotide
tcacagagtagtctattggt

SEQ ID NO: 1510 - DNA, 20 bp, Artificial sequence
  Synthetic oligonucleotide
gtaagtatagatgcctctcc

SEQ ID NO: 1511 - DNA, 20 bp, Artificial sequence
  Synthetic oligonucleotide
gcaaactttaggagtgtgtt

SEQ ID NO: 1512 - DNA, 20 bp, Artificial sequence
  Synthetic oligonucleotide
ggtattgacacctccaactg

SEQ ID NO: 1513 - DNA, 20 bp, Artificial sequence
  Synthetic oligonucleotide
atataagggtaatacggacc

SEQ ID NO: 1514 - DNA, 20 bp, Artificial sequence
  Synthetic oligonucleotide
gccccctgccgtgtgaaaga

SEQ ID NO: 1515 - DNA, 20 bp, Artificial sequence
  Synthetic oligonucleotide
cttcaagactaaggtaggga

SEQ ID NO: 1516 - DNA, 20 bp, Artificial sequence
  Synthetic oligonucleotide
gtatgcgaagcgaacgaagc

SEQ ID NO: 1517 - DNA, 20 bp, Artificial sequence
  Synthetic oligonucleotide
cctaaaaaacccgtgtacac

SEQ ID NO: 1518 - DNA, 20 bp, Artificial sequence
  Synthetic oligonucleotide
ggtggccttcagtcagtaca

SEQ ID NO: 1519 - DNA, 20 bp, Artificial sequence
  Synthetic oligonucleotide
gcccagactcatgctggtta

SEQ ID NO: 1520 - DNA, 20 bp, Artificial sequence
  Synthetic oligonucleotide
atacttcacctaatagcacc

SEQ ID NO: 1521 - DNA, 20 bp, Artificial sequence
  Synthetic oligonucleotide
ggagttctttaggttggaac

SEQ ID NO: 1522 - DNA, 20 bp, Artificial sequence
  Synthetic oligonucleotide
gcaactatgggtggagacat

SEQ ID NO: 1523 - DNA, 20 bp, Artificial sequence
  Synthetic oligonucleotide
tcgggccaggtccaggcgca

SEQ ID NO: 1524 - DNA, 20 bp, Artificial sequence
  Synthetic oligonucleotide
gctgtcatatgggaactacg

SEQ ID NO: 1525 - DNA, 20 bp, Artificial sequence
  Synthetic oligonucleotide
caaacctacgccaataaaga

SEQ ID NO: 1526 - DNA, 20 bp, Artificial sequence
  Synthetic oligonucleotide
tttatcgcttaaagtagcct

SEQ ID NO: 1527 - DNA, 20 bp, Artificial sequence
  Synthetic oligonucleotide
cgtatatcgaataccctcaa

SEQ ID NO: 1528 - DNA, 20 bp, Artificial sequence
  Synthetic oligonucleotide
gtaagagttagctattcccc

SEQ ID NO: 1529 - DNA, 20 bp, Artificial sequence
  Synthetic oligonucleotide
cagtaaagagccacctaagg

SEQ ID NO: 1530 - DNA, 20 bp, Artificial sequence
  Synthetic oligonucleotide
ggcaaggctaaggagtgctc

SEQ ID NO: 1531 - DNA, 20 bp, Artificial sequence
  Synthetic oligonucleotide
gctacccattagacccatgg

SEQ ID NO: 1532 - DNA, 20 bp, Artificial sequence
  Synthetic oligonucleotide
ggagtccctgtgtcattgga

SEQ ID NO: 1533 - DNA, 20 bp, Artificial sequence
  Synthetic oligonucleotide
ggatgtagcccatcaaccct

SEQ ID NO: 1534 - DNA, 20 bp, Artificial sequence
  Synthetic oligonucleotide
ccagttaatctctgacatgg

SEQ ID NO: 1535 - DNA, 20 bp, Artificial sequence
  Synthetic oligonucleotide
aggtgatgacacccctacca

SEQ ID NO: 1536 - DNA, 20 bp, Artificial sequence
  Synthetic oligonucleotide
gggtgtctctttgacaccac

SEQ ID NO: 1537 - DNA, 20 bp, Artificial sequence
  Synthetic oligonucleotide
aggcagtcagggtaatgcta

SEQ ID NO: 1538 - DNA, 20 bp, Artificial sequence
  Synthetic oligonucleotide
ccttctgtcccaacggagcc

SEQ ID NO: 1539 - DNA, 20 bp, Artificial sequence
  Synthetic oligonucleotide
ctctcgctgaggacacatca

SEQ ID NO: 1540 - DNA, 20 bp, Artificial sequence
  Synthetic oligonucleotide
accacagggtactattctgg

SEQ ID NO: 1541 - DNA, 20 bp, Artificial sequence
  Synthetic oligonucleotide
ctgctctgttagccgagcat

SEQ ID NO: 1542 - DNA, 20 bp, Artificial sequence
  Synthetic oligonucleotide
gcttgtatgccccactggag

SEQ ID NO: 1543 - DNA, 20 bp, Artificial sequence
  Synthetic oligonucleotide
gcttgccatgttttatagac

SEQ ID NO: 1544 - DNA, 20 bp, Artificial sequence
  Synthetic oligonucleotide
ctcaggatcgctggccattt

SEQ ID NO: 1545 - DNA, 20 bp, Artificial sequence
  Synthetic oligonucleotide
gcctaaaggtagttctccct

SEQ ID NO: 1546 - DNA, 20 bp, Artificial sequence
  Synthetic oligonucleotide
caggagggtgtcaaccagac

SEQ ID NO: 1547 - DNA, 20 bp, Artificial sequence
  Synthetic oligonucleotide
ggcagataacctccaagtgc

SEQ ID NO: 1548 - DNA, 20 bp, Artificial sequence
  Synthetic oligonucleotide
cacatagaccatagctgaac

SEQ ID NO: 1549 - DNA, 20 bp, Artificial sequence
  Synthetic oligonucleotide
gtctagtatgtctgagtgtc

SEQ ID NO: 1550 - DNA, 20 bp, Artificial sequence
  Synthetic oligonucleotide
gactcgggacatttaggatg

SEQ ID NO: 1551 - DNA, 20 bp, Artificial sequence
  Synthetic oligonucleotide
ataggccacgctggtcactg

SEQ ID NO: 1552 - DNA, 20 bp, Artificial sequence
  Synthetic oligonucleotide
tcatcctctatggacccacg

SEQ ID NO: 1553 - DNA, 20 bp, Artificial sequence
  Synthetic oligonucleotide
cccgacttacattacctacc

SEQ ID NO: 1554 - DNA, 20 bp, Artificial sequence
  Synthetic oligonucleotide
atgatctgctgttcagtgcg

SEQ ID NO: 1555 - DNA, 20 bp, Artificial sequence
  Synthetic oligonucleotide
aggccaagtggtgctcttcc

SEQ ID NO: 1556 - DNA, 20 bp, Artificial sequence
  Synthetic oligonucleotide
attcagatactagtttaccc

SEQ ID NO: 1557 - DNA, 20 bp, Artificial sequence
  Synthetic oligonucleotide
tctaggtaggctgagcctca

SEQ ID NO: 1558 - DNA, 20 bp, Artificial sequence
  Synthetic oligonucleotide
ttgtcttggaacatacggat

SEQ ID NO: 1559 - DNA, 20 bp, Artificial sequence
  Synthetic oligonucleotide
gattggcactattttgagcc

SEQ ID NO: 1560 - DNA, 20 bp, Artificial sequence
  Synthetic oligonucleotide
gatactccaaatatgacccg

SEQ ID NO: 1561 - DNA, 20 bp, Artificial sequence
  Synthetic oligonucleotide
aatagaatagtgccagtagg

SEQ ID NO: 1562 - DNA, 20 bp, Artificial sequence
  Synthetic oligonucleotide
ttgcaaggacccttaagtca

SEQ ID NO: 1563 - DNA, 20 bp, Artificial sequence
  Synthetic oligonucleotide
gtagccataatgccatagtc

SEQ ID NO: 1564 - DNA, 20 bp, Artificial sequence
  Synthetic oligonucleotide
gcatccttaaatcctggttg

SEQ ID NO: 1565 - DNA, 20 bp, Artificial sequence
  Synthetic oligonucleotide
gcaatatccatagtgatctg

SEQ ID NO: 1566 - DNA, 20 bp, Artificial sequence
  Synthetic oligonucleotide
cgttactgattatcttatcc

SEQ ID NO: 1567 - DNA, 20 bp, Artificial sequence
  Synthetic oligonucleotide
cccaccatgttaatcaaggc

SEQ ID NO: 1568 - DNA, 20 bp, Artificial sequence
  Synthetic oligonucleotide
caggtgtatattccctatcc

SEQ ID NO: 1569 - DNA, 20 bp, Artificial sequence
  Synthetic oligonucleotide
ccgaatgtgttatttatcct

SEQ ID NO: 1570 - DNA, 20 bp, Artificial sequence
  Synthetic oligonucleotide
ggttatctaatgcatcatca

SEQ ID NO: 1571 - DNA, 20 bp, Artificial sequence
  Synthetic oligonucleotide
ctaggcacactaaagtgcac

SEQ ID NO: 1572 - DNA, 20 bp, Artificial sequence
  Synthetic oligonucleotide
gatgcaatcacagcaagtac

SEQ ID NO: 1573 - DNA, 20 bp, Artificial sequence
  Synthetic oligonucleotide
gtcgagaactcaaaaggtga

SEQ ID NO: 1574 - DNA, 20 bp, Artificial sequence
  Synthetic oligonucleotide
gtttacccaggcaatggctc

SEQ ID NO: 1575 - DNA, 20 bp, Artificial sequence
  Synthetic oligonucleotide
gcaactcgatgttcttgctt

SEQ ID NO: 1576 - DNA, 20 bp, Artificial sequence
  Synthetic oligonucleotide
ttggtaaggcagctcctgac

SEQ ID NO: 1577 - DNA, 20 bp, Artificial sequence
  Synthetic oligonucleotide
tggtcccattgtagttgtgt

SEQ ID NO: 1578 - DNA, 20 bp, Artificial sequence
  Synthetic oligonucleotide
ctatcaaggctgttattggt

SEQ ID NO: 1579 - DNA, 20 bp, Artificial sequence
  Synthetic oligonucleotide
gcttctaactaacatgcctc

SEQ ID NO: 1580 - DNA, 20 bp, Artificial sequence
  Synthetic oligonucleotide
gggctccagtttatgtatcc

SEQ ID NO: 1581 - DNA, 20 bp, Artificial sequence
  Synthetic oligonucleotide
tagcctgcatggtttacagt

SEQ ID NO: 1582 - DNA, 20 bp, Artificial sequence
  Synthetic oligonucleotide
gggctcttgttactgagctg

SEQ ID NO: 1583 - DNA, 20 bp, Artificial sequence
  Synthetic oligonucleotide
tttcacaggagcgcacttgg

SEQ ID NO: 1584 - DNA, 20 bp, Artificial sequence
  Synthetic oligonucleotide
gagtagtctattggtgttcc

SEQ ID NO: 1585 - DNA, 20 bp, Artificial sequence
  Synthetic oligonucleotide
ccctacccttgcatgctatg

SEQ ID NO: 1586 - DNA, 20 bp, Artificial sequence
  Synthetic oligonucleotide
ccattgagtatattacctcc

SEQ ID NO: 1587 - DNA, 20 bp, Artificial sequence
  Synthetic oligonucleotide
cctccaactgtaatcattga

SEQ ID NO: 1588 - DNA, 20 bp, Artificial sequence
  Synthetic oligonucleotide
gtaatacggacctcatacag

SEQ ID NO: 1589 - DNA, 20 bp, Artificial sequence
  Synthetic oligonucleotide
actacttgtcccctgggctt

SEQ ID NO: 1590 - DNA, 20 bp, Artificial sequence
  Synthetic oligonucleotide
cttgcttgtatggtctgatg

SEQ ID NO: 1591 - DNA, 20 bp, Artificial sequence
  Synthetic oligonucleotide
aaaagtaggtttgcggatgc

SEQ ID NO: 1592 - DNA, 20 bp, Artificial sequence
  Synthetic oligonucleotide
acccgtgtacacagtgggat

SEQ ID NO: 1593 - DNA, 20 bp, Artificial sequence
  Synthetic oligonucleotide
gtcagtacacaagcaggtag

SEQ ID NO: 1594 - DNA, 20 bp, Artificial sequence
  Synthetic oligonucleotide
tcatgctggttactagggcc

SEQ ID NO: 1595 - DNA, 20 bp, Artificial sequence
  Synthetic oligonucleotide
gttaggccacaagacttaat

SEQ ID NO: 1596 - DNA, 20 bp, Artificial sequence
  Synthetic oligonucleotide
ctcaaacccgtataaagatg

SEQ ID NO: 1597 - DNA, 20 bp, Artificial sequence
  Synthetic oligonucleotide
gacatacaatggaccaccta

SEQ ID NO: 1598 - DNA, 20 bp, Artificial sequence
  Synthetic oligonucleotide
ggaagttccaacccttactc

SEQ ID NO: 1599 - DNA, 20 bp, Artificial sequence
  Synthetic oligonucleotide
gaatccactacatgggatta

SEQ ID NO: 1600 - DNA, 20 bp, Artificial sequence
  Synthetic oligonucleotide
gactaagcccgaaagttagc

SEQ ID NO: 1601 - DNA, 20 bp, Artificial sequence
  Synthetic oligonucleotide
cgcttaaagtagcctaagga

SEQ ID NO: 1602 - DNA, 20 bp, Artificial sequence
  Synthetic oligonucleotide
cgaataccctcaacttcacc

SEQ ID NO: 1603 - DNA, 20 bp, Artificial sequence
  Synthetic oligonucleotide
caaccttgatagcagcttat

SEQ ID NO: 1604 - DNA, 20 bp, Artificial sequence
  Synthetic oligonucleotide
gtgaaactaagcacatccga

SEQ ID NO: 1605 - DNA, 20 bp, Artificial sequence
  Synthetic oligonucleotide
ggctaaggagtgctctttgt

SEQ ID NO: 1606 - DNA, 20 bp, Artificial sequence
  Synthetic oligonucleotide
cccattagacccatggctca

SEQ ID NO: 1607 - DNA, 20 bp, Artificial sequence
  Synthetic oligonucleotide
tacaacagtcccaggctagg

SEQ ID NO: 1608 - DNA, 20 bp, Artificial sequence
  Synthetic oligonucleotide
gtagcccatcaaccctggga

SEQ ID NO: 1609 - DNA, 20 bp, Artificial sequence
  Synthetic oligonucleotide
ctgacatggactaataggcc

SEQ ID NO: 1610 - DNA, 20 bp, Artificial sequence
  Synthetic oligonucleotide
gacacccctaccatggctac

SEQ ID NO: 1611 - DNA, 20 bp, Artificial sequence
  Synthetic oligonucleotide
gtctctttgacaccaccaac

SEQ ID NO: 1612 - DNA, 20 bp, Artificial sequence
  Synthetic oligonucleotide
gtaatgctatcttccatgcc

SEQ ID NO: 1613 - DNA, 20 bp, Artificial sequence
  Synthetic oligonucleotide
gtcccaacggagccttacgc

SEQ ID NO: 1614 - DNA, 20 bp, Artificial sequence
  Synthetic oligonucleotide
cacatcagctgttagcagtc

SEQ ID NO: 1615 - DNA, 20 bp, Artificial sequence
  Synthetic oligonucleotide
actctgtaggttgacaggac

SEQ ID NO: 1616 - DNA, 20 bp, Artificial sequence
  Synthetic oligonucleotide
ctgttagccgagcattggct

SEQ ID NO: 1617 - DNA, 20 bp, Artificial sequence
  Synthetic oligonucleotide
atgccccactggagaagtct

SEQ ID NO: 1618 - DNA, 20 bp, Artificial sequence
  Synthetic oligonucleotide
cgtcttcccgcaccatgcat

SEQ ID NO: 1619 - DNA, 20 bp, Artificial sequence
  Synthetic oligonucleotide
cgtgtcactttcaggtcagc

SEQ ID NO: 1620 - DNA, 20 bp, Artificial sequence
  Synthetic oligonucleotide
ggtagttctcccttctgtca

SEQ ID NO: 1621 - DNA, 20 bp, Artificial sequence
  Synthetic oligonucleotide
gggtgtcaaccagacttcca

SEQ ID NO: 1622 - DNA, 20 bp, Artificial sequence
  Synthetic oligonucleotide
gctcatcacaactgggtggt

SEQ ID NO: 1623 - DNA, 20 bp, Artificial sequence
  Synthetic oligonucleotide
accatagctgaacctgtggc

SEQ ID NO: 1624 - DNA, 20 bp, Artificial sequence
  Synthetic oligonucleotide
gtctgagtgtcaggctgtaa

SEQ ID NO: 1625 - DNA, 20 bp, Artificial sequence
  Synthetic oligonucleotide
gtgtgccataggtttcaggc

SEQ ID NO: 1626 - DNA, 20 bp, Artificial sequence
  Synthetic oligonucleotide
ccacgctggtcactgaaaga

SEQ ID NO: 1627 - DNA, 20 bp, Artificial sequence
  Synthetic oligonucleotide
ccgctcaatgcaggacacca

SEQ ID NO: 1628 - DNA, 20 bp, Artificial sequence
  Synthetic oligonucleotide
tgctccataggtaagatggt

SEQ ID NO: 1629 - DNA, 20 bp, Artificial sequence
  Synthetic oligonucleotide
taggcactgcctttgttgcg

SEQ ID NO: 1630 - DNA, 20 bp, Artificial sequence
  Synthetic oligonucleotide
gtcgaagacaatataacatc

SEQ ID NO: 1631 - DNA, 20 bp, Artificial sequence
  Synthetic oligonucleotide
atcagggcacatggagttgt

SEQ ID NO: 1632 - DNA, 20 bp, Artificial sequence
  Synthetic oligonucleotide
cccttaggtgggagtcttcc

SEQ ID NO: 1633 - DNA, 20 bp, Artificial sequence
  Synthetic oligonucleotide
ggctctagaccattgactca

SEQ ID NO: 1634 - DNA, 20 bp, Artificial sequence
  Synthetic oligonucleotide
gtagtgcctcaatgatccac

SEQ ID NO: 1635 - DNA, 20 bp, Artificial sequence
  Synthetic oligonucleotide
ggtaaagtggactggatgcc

SEQ ID NO: 1636 - DNA, 20 bp, Artificial sequence
  Synthetic oligonucleotide
ctcatgaggattgcatcaca

SEQ ID NO: 1637 - DNA, 20 bp, Artificial sequence
  Synthetic oligonucleotide
aggaacggccctgactgtca

SEQ ID NO: 1638 - DNA, 20 bp, Artificial sequence
  Synthetic oligonucleotide
ccatatcaataacaattggc

SEQ ID NO: 1639 - DNA, 20 bp, Artificial sequence
  Synthetic oligonucleotide
ggaactccagccagtgaata

SEQ ID NO: 1640 - DNA, 20 bp, Artificial sequence
  Synthetic oligonucleotide
atgagggaagtctaggtctc

SEQ ID NO: 1641 - DNA, 20 bp, Artificial sequence
  Synthetic oligonucleotide
acataggcactctactagct

SEQ ID NO: 1642 - DNA, 20 bp, Artificial sequence
  Synthetic oligonucleotide
tatcagtcatagctacacac

SEQ ID NO: 1643 - DNA, 20 bp, Artificial sequence
  Synthetic oligonucleotide
ggtggatgtctgacttgact

SEQ ID NO: 1644 - DNA, 20 bp, Artificial sequence
  Synthetic oligonucleotide
gctaaagttgtggtctacca

SEQ ID NO: 1645 - DNA, 20 bp, Artificial sequence
  Synthetic oligonucleotide
ttctcatcatcgatccaaac

SEQ ID NO: 1646 - DNA, 20 bp, Artificial sequence
  Synthetic oligonucleotide
taatggcttagctactcacc

SEQ ID NO: 1647 - DNA, 20 bp, Artificial sequence
  Synthetic oligonucleotide
gagaacccacttgatctatt

SEQ ID NO: 1648 - DNA, 20 bp, Artificial sequence
  Synthetic oligonucleotide
ggacctcaggagattgtaca

SEQ ID NO: 1649 - DNA, 20 bp, Artificial sequence
  Synthetic oligonucleotide
tatagtgtggatggtatcct

SEQ ID NO: 1650 - DNA, 20 bp, Artificial sequence
  Synthetic oligonucleotide
gtacacagggatttgagcct

SEQ ID NO: 1651 - DNA, 20 bp, Artificial sequence
  Synthetic oligonucleotide
ggaacattcagctagactag

SEQ ID NO: 1652 - DNA, 20 bp, Artificial sequence
  Synthetic oligonucleotide
taaattggtctggttacaag

SEQ ID NO: 1653 - DNA, 20 bp, Artificial sequence
  Synthetic oligonucleotide
cctatagattgggctttaga

SEQ ID NO: 1654 - DNA, 20 bp, Artificial sequence
  Synthetic oligonucleotide
gtctatatttggtaagacac

SEQ ID NO: 1655 - DNA, 20 bp, Artificial sequence
  Synthetic oligonucleotide
attggtcatctcgggtatat

SEQ ID NO: 1656 - DNA, 20 bp, Artificial sequence
  Synthetic oligonucleotide
ttcagaccgaaggagttcct

SEQ ID NO: 1657 - DNA, 20 bp, Artificial sequence
  Synthetic oligonucleotide
gtaggatctatggcagttcc

SEQ ID NO: 1658 - DNA, 20 bp, Artificial sequence
  Synthetic oligonucleotide
gttctacagagtggagccag

SEQ ID NO: 1659 - DNA, 20 bp, Artificial sequence
  Synthetic oligonucleotide
gattggtggtttattcatcg

SEQ ID NO: 1660 - DNA, 20 bp, Artificial sequence
  Synthetic oligonucleotide
tacccattgcaagttaacta

SEQ ID NO: 1661 - DNA, 20 bp, Artificial sequence
  Synthetic oligonucleotide
tcctaatagttggaggtggt

SEQ ID NO: 1662 - DNA, 20 bp, Artificial sequence
  Synthetic oligonucleotide
cagcctaatatgtgtcatcc

SEQ ID NO: 1663 - DNA, 20 bp, Artificial sequence
  Synthetic oligonucleotide
cgttacctcaattctatggt

SEQ ID NO: 1664 - DNA, 20 bp, Artificial sequence
  Synthetic oligonucleotide
actggagtcctggttgatgt

SEQ ID NO: 1665 - DNA, 20 bp, Artificial sequence
  Synthetic oligonucleotide
acaaaacgggcatgctttat

SEQ ID NO: 1666 - DNA, 20 bp, Artificial sequence
  Synthetic oligonucleotide
gcggataaattggatttatc

SEQ ID NO: 1667 - DNA, 20 bp, Artificial sequence
  Synthetic oligonucleotide
aggcaatggacttagtacac

SEQ ID NO: 1668 - DNA, 20 bp, Artificial sequence
  Synthetic oligonucleotide
cccagggtaggattcatggt

SEQ ID NO: 1669 - DNA, 20 bp, Artificial sequence
  Synthetic oligonucleotide
caagtgatgatgttgtatgc

SEQ ID NO: 1670 - DNA, 20 bp, Artificial sequence
  Synthetic oligonucleotide
atccccgaatgggagagatt

SEQ ID NO: 1671 - DNA, 20 bp, Artificial sequence
  Synthetic oligonucleotide
gtgaacgaatactgtggcat

SEQ ID NO: 1672 - DNA, 20 bp, Artificial sequence
  Synthetic oligonucleotide
ccaacctgtcatgggactgc

SEQ ID NO: 1673 - DNA, 20 bp, Artificial sequence
  Synthetic oligonucleotide
taggcctaatctatgctggg

SEQ ID NO: 1674 - DNA, 20 bp, Artificial sequence
  Synthetic oligonucleotide
tctcaaaagacattcggtac

SEQ ID NO: 1675 - DNA, 20 bp, Artificial sequence
  Synthetic oligonucleotide
ccatgggcagattgatcacc

SEQ ID NO: 1676 - DNA, 20 bp, Artificial sequence
  Synthetic oligonucleotide
tgcctaagggagtttgtcac

SEQ ID NO: 1677 - DNA, 20 bp, Artificial sequence
  Synthetic oligonucleotide
atgtttagaggtcaagccct

SEQ ID NO: 1678 - DNA, 20 bp, Artificial sequence
  Synthetic oligonucleotide
tgggtcggatatagctttta

SEQ ID NO: 1679 - DNA, 20 bp, Artificial sequence
  Synthetic oligonucleotide
gacatctgcttatgtagctc

SEQ ID NO: 1680 - DNA, 20 bp, Artificial sequence
  Synthetic oligonucleotide
agttactttgggacatccca

SEQ ID NO: 1681 - DNA, 20 bp, Artificial sequence
  Synthetic oligonucleotide
gtttggaacatcatgttagc

SEQ ID NO: 1682 - DNA, 20 bp, Artificial sequence
  Synthetic oligonucleotide
tccaactgatgcatcaagcc

SEQ ID NO: 1683 - DNA, 20 bp, Artificial sequence
  Synthetic oligonucleotide
gcctatatccaaccagctac

SEQ ID NO: 1684 - DNA, 20 bp, Artificial sequence
  Synthetic oligonucleotide
cgttggaaacttcaaaggca

SEQ ID NO: 1685 - DNA, 20 bp, Artificial sequence
  Synthetic oligonucleotide
ccttggttgtggtgaaaccc

SEQ ID NO: 1686 - DNA, 20 bp, Artificial sequence
  Synthetic oligonucleotide
tatcttaactggtgaactcc

SEQ ID NO: 1687 - DNA, 20 bp, Artificial sequence
  Synthetic oligonucleotide
ggatggttgacctcaaaatt

SEQ ID NO: 1688 - DNA, 20 bp, Artificial sequence
  Synthetic oligonucleotide
tggttacccatacagtatat

SEQ ID NO: 1689 - DNA, 20 bp, Artificial sequence
  Synthetic oligonucleotide
gcttttcagtcaggtacagg

SEQ ID NO: 1690 - DNA, 20 bp, Artificial sequence
  Synthetic oligonucleotide
gacctgtgagggtgcttagt

SEQ ID NO: 1691 - DNA, 20 bp, Artificial sequence
  Synthetic oligonucleotide
gtttgaccagctccttgttg

SEQ ID NO: 1692 - DNA, 20 bp, Artificial sequence
  Synthetic oligonucleotide
ttgggagtgctccacacttc

SEQ ID NO: 1693 - DNA, 20 bp, Artificial sequence
  Synthetic oligonucleotide
gatgccctggtcctagcttc

SEQ ID NO: 1694 - DNA, 20 bp, Artificial sequence
  Synthetic oligonucleotide
gatagccattcgatacctgc

SEQ ID NO: 1695 - DNA, 20 bp, Artificial sequence
  Synthetic oligonucleotide
gcttctacataaccgaagtg

SEQ ID NO: 1696 - DNA, 20 bp, Artificial sequence
  Synthetic oligonucleotide
ctagtgcctattacaatctg

SEQ ID NO: 1697 - DNA, 20 bp, Artificial sequence
  Synthetic oligonucleotide
catgtgctttgtggacccat

SEQ ID NO: 1698 - DNA, 20 bp, Artificial sequence
  Synthetic oligonucleotide
gctggacggacagtgttgct

SEQ ID NO: 1699 - DNA, 20 bp, Artificial sequence
  Synthetic oligonucleotide
ggtgatgaaggtcaagccga

SEQ ID NO: 1700 - DNA, 20 bp, Artificial sequence
  Synthetic oligonucleotide
gtggtttccagcagggtgta

SEQ ID NO: 1701 - DNA, 20 bp, Artificial sequence
  Synthetic oligonucleotide
actaaagagtactcctacca

SEQ ID NO: 1702 - DNA, 20 bp, Artificial sequence
  Synthetic oligonucleotide
gtaatgatttgccctcctac

SEQ ID NO: 1703 - DNA, 20 bp, Artificial sequence
  Synthetic oligonucleotide
ccagcgggacctggacaagc

SEQ ID NO: 1704 - DNA, 20 bp, Artificial sequence
  Synthetic oligonucleotide
ggtgtagtggcaagaagttc

SEQ ID NO: 1705 - DNA, 20 bp, Artificial sequence
  Synthetic oligonucleotide
ccccctagctttccaatggg

SEQ ID NO: 1706 - DNA, 20 bp, Artificial sequence
  Synthetic oligonucleotide
gtctccacataatcctattg

SEQ ID NO: 1707 - DNA, 20 bp, Artificial sequence
  Synthetic oligonucleotide
acatcccattaatcatcgct

SEQ ID NO: 1708 - DNA, 20 bp, Artificial sequence
  Synthetic oligonucleotide
tcagattacctgaaggtgta

SEQ ID NO: 1709 - DNA, 20 bp, Artificial sequence
  Synthetic oligonucleotide
agtggacagatacggtccgt

SEQ ID NO: 1710 - DNA, 20 bp, Artificial sequence
  Synthetic oligonucleotide
tcagttgtgagtagtgcctc

SEQ ID NO: 1711 - DNA, 20 bp, Artificial sequence
  Synthetic oligonucleotide
gcttaccagagatggtttcc

SEQ ID NO: 1712 - DNA, 20 bp, Artificial sequence
  Synthetic oligonucleotide
cgtagggcaaaagtaaggat

SEQ ID NO: 1713 - DNA, 20 bp, Artificial sequence
  Synthetic oligonucleotide
gtggcctgaaggaacggccc

SEQ ID NO: 1714 - DNA, 20 bp, Artificial sequence
  Synthetic oligonucleotide
gaccttcaattgatcagtct

SEQ ID NO: 1715 - DNA, 20 bp, Artificial sequence
  Synthetic oligonucleotide
cctgtctggtactcccatat

SEQ ID NO: 1716 - DNA, 20 bp, Artificial sequence
  Synthetic oligonucleotide
tcaatatgagggaagtctag

SEQ ID NO: 1717 - DNA, 20 bp, Artificial sequence
  Synthetic oligonucleotide
ttaactacataggcactcta

SEQ ID NO: 1718 - DNA, 20 bp, Artificial sequence
  Synthetic oligonucleotide
ctacaccgtgacaaaagagc

SEQ ID NO: 1719 - DNA, 20 bp, Artificial sequence
  Synthetic oligonucleotide
agcacaggtggatgtctgac

SEQ ID NO: 1720 - DNA, 20 bp, Artificial sequence
  Synthetic oligonucleotide
gtagttgtatcttgaatggg

SEQ ID NO: 1721 - DNA, 20 bp, Artificial sequence
  Synthetic oligonucleotide
catctggacctcagattgac

SEQ ID NO: 1722 - DNA, 20 bp, Artificial sequence
  Synthetic oligonucleotide
aacgacctaaagacctagca

SEQ ID NO: 1723 - DNA, 20 bp, Artificial sequence
  Synthetic oligonucleotide
cttgagtaactactcatgac

SEQ ID NO: 1724 - DNA, 20 bp, Artificial sequence
  Synthetic oligonucleotide
gacctataggacctcaggag

SEQ ID NO: 1725 - DNA, 20 bp, Artificial sequence
  Synthetic oligonucleotide
ctaactttatagtgtggatg

SEQ ID NO: 1726 - DNA, 20 bp, Artificial sequence
  Synthetic oligonucleotide
ccacacatataggctagcca

SEQ ID NO: 1727 - DNA, 20 bp, Artificial sequence
  Synthetic oligonucleotide
ggtcatcatattgaaccaat

SEQ ID NO: 1728 - DNA, 20 bp, Artificial sequence
  Synthetic oligonucleotide
gatttccttactgagtgagc

SEQ ID NO: 1729 - DNA, 20 bp, Artificial sequence
  Synthetic oligonucleotide
ggtagtctatatttggtaag

SEQ ID NO: 1730 - DNA, 20 bp, Artificial sequence
  Synthetic oligonucleotide
ttattggtcatctcgggtat

SEQ ID NO: 1731 - DNA, 20 bp, Artificial sequence
  Synthetic oligonucleotide
ctatttcagaccgaaggagt

SEQ ID NO: 1732 - DNA, 20 bp, Artificial sequence
  Synthetic oligonucleotide
gtaactggtaggatctatgg

SEQ ID NO: 1733 - DNA, 20 bp, Artificial sequence
  Synthetic oligonucleotide
tttttagggtagtgtcctga

SEQ ID NO: 1734 - DNA, 20 bp, Artificial sequence
  Synthetic oligonucleotide
cttagtgattggtggtttat

SEQ ID NO: 1735 - DNA, 20 bp, Artificial sequence
  Synthetic oligonucleotide
gggatttacccattgcaagt

SEQ ID NO: 1736 - DNA, 20 bp, Artificial sequence
  Synthetic oligonucleotide
gccatcctaatagttggagg

SEQ ID NO: 1737 - DNA, 20 bp, Artificial sequence
  Synthetic oligonucleotide
ggttaagtctgctctttcac

SEQ ID NO: 1738 - DNA, 20 bp, Artificial sequence
  Synthetic oligonucleotide
tcgcccgttacctcaattct

SEQ ID NO: 1739 - DNA, 20 bp, Artificial sequence
  Synthetic oligonucleotide
gctattacactggagtcctg

SEQ ID NO: 1740 - DNA, 20 bp, Artificial sequence
  Synthetic oligonucleotide
caatacaaaacgggcatgct

SEQ ID NO: 1741 - DNA, 20 bp, Artificial sequence
  Synthetic oligonucleotide
gatcattccctgtggtaaag

SEQ ID NO: 1742 - DNA, 20 bp, Artificial sequence
  Synthetic oligonucleotide
gcttaggcaatggacttagt

SEQ ID NO: 1743 - DNA, 20 bp, Artificial sequence
  Synthetic oligonucleotide
catacccagggtaggattca

SEQ ID NO: 1744 - DNA, 20 bp, Artificial sequence
  Synthetic oligonucleotide
ataacactaacgatgaactc

SEQ ID NO: 1745 - DNA, 20 bp, Artificial sequence
  Synthetic oligonucleotide
cctaaaatccccgaatggga

SEQ ID NO: 1746 - DNA, 20 bp, Artificial sequence
  Synthetic oligonucleotide
cccagttaatcagtgaacga

SEQ ID NO: 1747 - DNA, 20 bp, Artificial sequence
  Synthetic oligonucleotide
atgttccaacctgtcatggg

SEQ ID NO: 1748 - DNA, 20 bp, Artificial sequence
  Synthetic oligonucleotide
gatgagattaggcctaatct

SEQ ID NO: 1749 - DNA, 20 bp, Artificial sequence
  Synthetic oligonucleotide
ccatctactattaatgagct

SEQ ID NO: 1750 - DNA, 20 bp, Artificial sequence
  Synthetic oligonucleotide
tcaccatgggcagattgatc

SEQ ID NO: 1751 - DNA, 20 bp, Artificial sequence
  Synthetic oligonucleotide
caaaacatgttctgacctcg

SEQ ID NO: 1752 - DNA, 20 bp, Artificial sequence
  Synthetic oligonucleotide
ggcctttgggtcggatatag

SEQ ID NO: 1753 - DNA, 20 bp, Artificial sequence
  Synthetic oligonucleotide
cgtcaaactgacatctgctt

SEQ ID NO: 1754 - DNA, 20 bp, Artificial sequence
  Synthetic oligonucleotide
agttaacacctatcaagttg

SEQ ID NO: 1755 - DNA, 20 bp, Artificial sequence
  Synthetic oligonucleotide
ggccacctgacttcggccca

SEQ ID NO: 1756 - DNA, 20 bp, Artificial sequence
  Synthetic oligonucleotide
gacttccaactgatgcatca

SEQ ID NO: 1757 - DNA, 20 bp, Artificial sequence
  Synthetic oligonucleotide
gacccttctgtgaaagccta

SEQ ID NO: 1758 - DNA, 20 bp, Artificial sequence
  Synthetic oligonucleotide
gactgcatctcaatcctatg

SEQ ID NO: 1759 - DNA, 20 bp, Artificial sequence
  Synthetic oligonucleotide
gcccatatgcttgaacaatt

SEQ ID NO: 1760 - DNA, 20 bp, Artificial sequence
  Synthetic oligonucleotide
gtatcttaactggtgaactc

SEQ ID NO: 1761 - DNA, 20 bp, Artificial sequence
  Synthetic oligonucleotide
gcagtttggatggttgacct

SEQ ID NO: 1762 - DNA, 20 bp, Artificial sequence
  Synthetic oligonucleotide
gggtcgactgatggttaccc

SEQ ID NO: 1763 - DNA, 20 bp, Artificial sequence
  Synthetic oligonucleotide
ataggagctgaatagtaggg

SEQ ID NO: 1764 - DNA, 20 bp, Artificial sequence
  Synthetic oligonucleotide
tcaaagacctgtgagggtgc

SEQ ID NO: 1765 - DNA, 20 bp, Artificial sequence
  Synthetic oligonucleotide
ggtgagctgtttgaccagct

SEQ ID NO: 1766 - DNA, 20 bp, Artificial sequence
  Synthetic oligonucleotide
tcattttgggagtgctccac

SEQ ID NO: 1767 - DNA, 20 bp, Artificial sequence
  Synthetic oligonucleotide
ggagatccaacctgtgtgga

SEQ ID NO: 1768 - DNA, 20 bp, Artificial sequence
  Synthetic oligonucleotide
ctgcaggatagccattcgat

SEQ ID NO: 1769 - DNA, 20 bp, Artificial sequence
  Synthetic oligonucleotide
cattattcaattaagggtgg

SEQ ID NO: 1770 - DNA, 20 bp, Artificial sequence
  Synthetic oligonucleotide
catgtgttaacggaactgag

SEQ ID NO: 1771 - DNA, 20 bp, Artificial sequence
  Synthetic oligonucleotide
gtgcatagagcagactgtac

SEQ ID NO: 1772 - DNA, 20 bp, Artificial sequence
  Synthetic oligonucleotide
ggttttgagagctggacgga

SEQ ID NO: 1773 - DNA, 20 bp, Artificial sequence
  Synthetic oligonucleotide
ataggtaggtgatgaaggtc

SEQ ID NO: 1774 - DNA, 20 bp, Artificial sequence
  Synthetic oligonucleotide
gctgccagcttagagaatct

SEQ ID NO: 1775 - DNA, 20 bp, Artificial sequence
  Synthetic oligonucleotide
gttaactaaagagtactcct

SEQ ID NO: 1776 - DNA, 20 bp, Artificial sequence
  Synthetic oligonucleotide
gtaggagataggcagtgcat

SEQ ID NO: 1777 - DNA, 20 bp, Artificial sequence
  Synthetic oligonucleotide
aattatactgtcctacttcg

SEQ ID NO: 1778 - DNA, 20 bp, Artificial sequence
  Synthetic oligonucleotide
gtaccccagaaatagcccat

SEQ ID NO: 1779 - DNA, 20 bp, Artificial sequence
  Synthetic oligonucleotide
catcactagcctagtgatct

SEQ ID NO: 1780 - DNA, 20 bp, Artificial sequence
  Synthetic oligonucleotide
gggtgctgtcaactgtccca

SEQ ID NO: 1781 - DNA, 20 bp, Artificial sequence
  Synthetic oligonucleotide
ggcaaagtacatactgatcc

SEQ ID NO: 1782 - DNA, 20 bp, Artificial sequence
  Synthetic oligonucleotide
cctgtgcggtagcacttgcc

SEQ ID NO: 1783 - DNA, 20 bp, Artificial sequence
  Synthetic oligonucleotide
gggccaagcacataggtatc

SEQ ID NO: 1784 - DNA, 20 bp, Artificial sequence
  Synthetic oligonucleotide
cgtgcaaaacaagtttcgca

SEQ ID NO: 1785 - DNA, 20 bp, Artificial sequence
  Synthetic oligonucleotide
gaccacgataactgtagcgc

SEQ ID NO: 1786 - DNA, 20 bp, Artificial sequence
  Synthetic oligonucleotide
tcctggcaagtatgctagtc

SEQ ID NO: 1787 - DNA, 20 bp, Artificial sequence
  Synthetic oligonucleotide
actgatccattagataggct

SEQ ID NO: 1788 - DNA, 20 bp, Artificial sequence
  Synthetic oligonucleotide
agaacacttcgccgctgatt

SEQ ID NO: 1789 - DNA, 20 bp, Artificial sequence
  Synthetic oligonucleotide
aacataaggttcaaaagccg

SEQ ID NO: 1790 - DNA, 20 bp, Artificial sequence
  Synthetic oligonucleotide
catagatgatcccataatag

SEQ ID NO: 1791 - DNA, 20 bp, Artificial sequence
  Synthetic oligonucleotide
ccgaaagcactttgcatgag

SEQ ID NO: 1792 - DNA, 20 bp, Artificial sequence
  Synthetic oligonucleotide
atccttgatccagacaagtc

SEQ ID NO: 1793 - DNA, 20 bp, Artificial sequence
  Synthetic oligonucleotide
atcatacaggcatctcagcc

SEQ ID NO: 1794 - DNA, 20 bp, Artificial sequence
  Synthetic oligonucleotide
tgtcactgagggatccccaa

SEQ ID NO: 1795 - DNA, 20 bp, Artificial sequence
  Synthetic oligonucleotide
ggattcaatagtgtaggtga

SEQ ID NO: 1796 - DNA, 20 bp, Artificial sequence
  Synthetic oligonucleotide
gtacaatgcatgtgggcctc

SEQ ID NO: 1797 - DNA, 20 bp, Artificial sequence
  Synthetic oligonucleotide
actggcatattccgattata

SEQ ID NO: 1798 - DNA, 20 bp, Artificial sequence
  Synthetic oligonucleotide
cgtattggacctttcaatga

SEQ ID NO: 1799 - DNA, 20 bp, Artificial sequence
  Synthetic oligonucleotide
attgaagctggcaatatgtc

SEQ ID NO: 1800 - DNA, 20 bp, Artificial sequence
  Synthetic oligonucleotide
gcatgtacaaacgggctatg

SEQ ID NO: 1801 - DNA, 20 bp, Artificial sequence
  Synthetic oligonucleotide
ggaatcttgtagaggattgg

SEQ ID NO: 1802 - DNA, 20 bp, Artificial sequence
  Synthetic oligonucleotide
tcagcacttaggtagttcac

SEQ ID NO: 1803 - DNA, 20 bp, Artificial sequence
  Synthetic oligonucleotide
tgtcttttgacacgctgact

SEQ ID NO: 1804 - DNA, 20 bp, Artificial sequence
  Synthetic oligonucleotide
gtactcttgcccatggatgg

SEQ ID NO: 1805 - DNA, 20 bp, Artificial sequence
  Synthetic oligonucleotide
cccctgtggcttataggtgg

SEQ ID NO: 1806 - DNA, 20 bp, Artificial sequence
  Synthetic oligonucleotide
ggatgaacctgcttcacaca

SEQ ID NO: 1807 - DNA, 20 bp, Artificial sequence
  Synthetic oligonucleotide
cagatttgccaggtaaagcg

SEQ ID NO: 1808 - DNA, 20 bp, Artificial sequence
  Synthetic oligonucleotide
aactatcctgcatccgaggc

SEQ ID NO: 1809 - DNA, 20 bp, Artificial sequence
  Synthetic oligonucleotide
ggtcaaccaatttgctattc

SEQ ID NO: 1810 - DNA, 20 bp, Artificial sequence
  Synthetic oligonucleotide
ggtcttgggattatagtttg

SEQ ID NO: 1811 - DNA, 20 bp, Artificial sequence
  Synthetic oligonucleotide
ggagttcctaactctcaatc

SEQ ID NO: 1812 - DNA, 20 bp, Artificial sequence
  Synthetic oligonucleotide
tctactgaggaacccatcac

SEQ ID NO: 1813 - DNA, 20 bp, Artificial sequence
  Synthetic oligonucleotide
cgttgcataacatgtgtatt

SEQ ID NO: 1814 - DNA, 20 bp, Artificial sequence
  Synthetic oligonucleotide
tacacctgcaacaagccatc

SEQ ID NO: 1815 - DNA, 20 bp, Artificial sequence
  Synthetic oligonucleotide
gagcaaatcggcaaaggcat

SEQ ID NO: 1816 - DNA, 20 bp, Artificial sequence
  Synthetic oligonucleotide
ccaagtggcttgtggtgaaa

SEQ ID NO: 1817 - DNA, 20 bp, Artificial sequence
  Synthetic oligonucleotide
gaactacgaataattgcatg

SEQ ID NO: 1818 - DNA, 20 bp, Artificial sequence
  Synthetic oligonucleotide
caatggtttagtgtcatatg

SEQ ID NO: 1819 - DNA, 20 bp, Artificial sequence
  Synthetic oligonucleotide
agtagctgtttaggctggac

SEQ ID NO: 1820 - DNA, 20 bp, Artificial sequence
  Synthetic oligonucleotide
ttgccctgccactcccgtgg

SEQ ID NO: 1821 - DNA, 20 bp, Artificial sequence
  Synthetic oligonucleotide
gggatatatcacttggagct

SEQ ID NO: 1822 - DNA, 20 bp, Artificial sequence
  Synthetic oligonucleotide
cagattaggtatggaggcca

SEQ ID NO: 1823 - DNA, 20 bp, Artificial sequence
  Synthetic oligonucleotide
acggattagattctccaaca

SEQ ID NO: 1824 - DNA, 20 bp, Artificial sequence
  Synthetic oligonucleotide
aggacacatcaagctagcta

SEQ ID NO: 1825 - DNA, 20 bp, Artificial sequence
  Synthetic oligonucleotide
aagccctttgctttttcggg

SEQ ID NO: 1826 - DNA, 20 bp, Artificial sequence
  Synthetic oligonucleotide
gtgttttgacctaactggcc

SEQ ID NO: 1827 - DNA, 20 bp, Artificial sequence
  Synthetic oligonucleotide
cgtgggtatggttttcctct

SEQ ID NO: 1828 - DNA, 20 bp, Artificial sequence
  Synthetic oligonucleotide
tccaacgagtgataattcac

SEQ ID NO: 1829 - DNA, 20 bp, Artificial sequence
  Synthetic oligonucleotide
aattgatgcataagtaaggc

SEQ ID NO: 1830 - DNA, 20 bp, Artificial sequence
  Synthetic oligonucleotide
ataggcacttcgggcaaata

SEQ ID NO: 1831 - DNA, 20 bp, Artificial sequence
  Synthetic oligonucleotide
ggatttaggtgctacagtca

SEQ ID NO: 1832 - DNA, 20 bp, Artificial sequence
  Synthetic oligonucleotide
gttagcccaggtgatcagct

SEQ ID NO: 1833 - DNA, 20 bp, Artificial sequence
  Synthetic oligonucleotide
attgcaactaataaagggtc

SEQ ID NO: 1834 - DNA, 20 bp, Artificial sequence
  Synthetic oligonucleotide
gctctcatgtgagagtatga

SEQ ID NO: 1835 - DNA, 20 bp, Artificial sequence
  Synthetic oligonucleotide
tcatgaattcaggttgcccc

SEQ ID NO: 1836 - DNA, 20 bp, Artificial sequence
  Synthetic oligonucleotide
ctttggttggaagttagacc

SEQ ID NO: 1837 - DNA, 20 bp, Artificial sequence
  Synthetic oligonucleotide
ctgcttattgcaggcctagc

SEQ ID NO: 1838 - DNA, 20 bp, Artificial sequence
  Synthetic oligonucleotide
cagttgagaacggtattgag

SEQ ID NO: 1839 - DNA, 20 bp, Artificial sequence
  Synthetic oligonucleotide
gtctgtctttagggtcaccc

SEQ ID NO: 1840 - DNA, 20 bp, Artificial sequence
  Synthetic oligonucleotide
gctttaggatggtgtggatc

SEQ ID NO: 1841 - DNA, 20 bp, Artificial sequence
  Synthetic oligonucleotide
ctctcactgactagctttcg

SEQ ID NO: 1842 - DNA, 20 bp, Artificial sequence
  Synthetic oligonucleotide
cttaccgtctttaggaactt

SEQ ID NO: 1843 - DNA, 20 bp, Artificial sequence
  Synthetic oligonucleotide
ggacagcacaacccccgtgc

SEQ ID NO: 1844 - DNA, 20 bp, Artificial sequence
  Synthetic oligonucleotide
ccctacaatgcatacccaac

SEQ ID NO: 1845 - DNA, 20 bp, Artificial sequence
  Synthetic oligonucleotide
gagttatacacggaacccac

SEQ ID NO: 1846 - DNA, 20 bp, Artificial sequence
  Synthetic oligonucleotide
gtccaagacatgctagggac

SEQ ID NO: 1847 - DNA, 20 bp, Artificial sequence
  Synthetic oligonucleotide
caatctagttagaccaggca

SEQ ID NO: 1848 - DNA, 20 bp, Artificial sequence
  Synthetic oligonucleotide
atggactgccggcctggagc

SEQ ID NO: 1849 - DNA, 20 bp, Artificial sequence
  Synthetic oligonucleotide
gtgaactacttggagacctt

SEQ ID NO: 1850 - DNA, 20 bp, Artificial sequence
  Synthetic oligonucleotide
acgcaactgagacaatccat

SEQ ID NO: 1851 - DNA, 20 bp, Artificial sequence
  Synthetic oligonucleotide
gtggctgtgctggatattac

SEQ ID NO: 1852 - DNA, 20 bp, Artificial sequence
  Synthetic oligonucleotide
gagcaaaatggtcagtaccc

SEQ ID NO: 1853 - DNA, 20 bp, Artificial sequence
  Synthetic oligonucleotide
gataggtcagtcactcactg

SEQ ID NO: 1854 - DNA, 20 bp, Artificial sequence
  Synthetic oligonucleotide
ggatgcattggtgtcaagag

SEQ ID NO: 1855 - DNA, 20 bp, Artificial sequence
  Synthetic oligonucleotide
ggtttacacatgataggaac

SEQ ID NO: 1856 - DNA, 20 bp, Artificial sequence
  Synthetic oligonucleotide
aacaacggttgcagggacag

SEQ ID NO: 1857 - DNA, 20 bp, Artificial sequence
  Synthetic oligonucleotide
ccccgtgtacagtaagggcc

SEQ ID NO: 1858 - DNA, 20 bp, Artificial sequence
  Synthetic oligonucleotide
gtcttagtgccaaatatcca

SEQ ID NO: 1859 - DNA, 20 bp, Artificial sequence
  Synthetic oligonucleotide
tatttagaccacgataactg

SEQ ID NO: 1860 - DNA, 20 bp, Artificial sequence
  Synthetic oligonucleotide
tccctcttgtagatcctggc

SEQ ID NO: 1861 - DNA, 20 bp, Artificial sequence
  Synthetic oligonucleotide
gagatatgattagtactgga

SEQ ID NO: 1862 - DNA, 20 bp, Artificial sequence
  Synthetic oligonucleotide
gagatagaacacttcgccgc

SEQ ID NO: 1863 - DNA, 20 bp, Artificial sequence
  Synthetic oligonucleotide
gtgattaggcggccgggcgc

SEQ ID NO: 1864 - DNA, 20 bp, Artificial sequence
  Synthetic oligonucleotide
cttatggagacttatatacc

SEQ ID NO: 1865 - DNA, 20 bp, Artificial sequence
  Synthetic oligonucleotide
gggtagaagactagcataca

SEQ ID NO: 1866 - DNA, 20 bp, Artificial sequence
  Synthetic oligonucleotide
gtacttatccttgatccaga

SEQ ID NO: 1867 - DNA, 20 bp, Artificial sequence
  Synthetic oligonucleotide
agcacaagattggttccatt

SEQ ID NO: 1868 - DNA, 20 bp, Artificial sequence
  Synthetic oligonucleotide
gggtactatgttgtcactga

SEQ ID NO: 1869 - DNA, 20 bp, Artificial sequence
  Synthetic oligonucleotide
atgaaccatggagtctctat

SEQ ID NO: 1870 - DNA, 20 bp, Artificial sequence
  Synthetic oligonucleotide
ggctttatactttacccaac

SEQ ID NO: 1871 - DNA, 20 bp, Artificial sequence
  Synthetic oligonucleotide
gtagataactttaccttgac

SEQ ID NO: 1872 - DNA, 20 bp, Artificial sequence
  Synthetic oligonucleotide
gtttatagggtggttggttc

SEQ ID NO: 1873 - DNA, 20 bp, Artificial sequence
  Synthetic oligonucleotide
gggttactttccaatagagt

SEQ ID NO: 1874 - DNA, 20 bp, Artificial sequence
  Synthetic oligonucleotide
aggcatgtacaaacgggcta

SEQ ID NO: 1875 - DNA, 20 bp, Artificial sequence
  Synthetic oligonucleotide
gttctggaatcttgtagagg

SEQ ID NO: 1876 - DNA, 20 bp, Artificial sequence
  Synthetic oligonucleotide
cccattcagcacttaggtag

SEQ ID NO: 1877 - DNA, 20 bp, Artificial sequence
  Synthetic oligonucleotide
ctgctcaaatctgcgaatag

SEQ ID NO: 1878 - DNA, 20 bp, Artificial sequence
  Synthetic oligonucleotide
gaggatggtgtgtatgttat

SEQ ID NO: 1879 - DNA, 20 bp, Artificial sequence
  Synthetic oligonucleotide
tcccacaaggtactcttgcc

SEQ ID NO: 1880 - DNA, 20 bp, Artificial sequence
  Synthetic oligonucleotide
gcatcccctgtggcttatag

SEQ ID NO: 1881 - DNA, 20 bp, Artificial sequence
  Synthetic oligonucleotide
tcagttagtcaggttaggga

SEQ ID NO: 1882 - DNA, 20 bp, Artificial sequence
  Synthetic oligonucleotide
agctattgcagctatgggtt

SEQ ID NO: 1883 - DNA, 20 bp, Artificial sequence
  Synthetic oligonucleotide
gttcaaccatcgagatgatc

SEQ ID NO: 1884 - DNA, 20 bp, Artificial sequence
  Synthetic oligonucleotide
gatagggtttaggtcaacca

SEQ ID NO: 1885 - DNA, 20 bp, Artificial sequence
  Synthetic oligonucleotide
atctggtcttgggattatag

SEQ ID NO: 1886 - DNA, 20 bp, Artificial sequence
  Synthetic oligonucleotide
cttaggagttcctaactctc

SEQ ID NO: 1887 - DNA, 20 bp, Artificial sequence
  Synthetic oligonucleotide
gttttggagattgtgttacg

SEQ ID NO: 1888 - DNA, 20 bp, Artificial sequence
  Synthetic oligonucleotide
ggagccaggtagagttaacg

SEQ ID NO: 1889 - DNA, 20 bp, Artificial sequence
  Synthetic oligonucleotide
ggatagttgtgaacaacttc

SEQ ID NO: 1890 - DNA, 20 bp, Artificial sequence
  Synthetic oligonucleotide
cattgaatgagggcccaaac

SEQ ID NO: 1891 - DNA, 20 bp, Artificial sequence
  Synthetic oligonucleotide
ggacttgtcttatggctgcc

SEQ ID NO: 1892 - DNA, 20 bp, Artificial sequence
  Synthetic oligonucleotide
tgattattcagagaactacg

SEQ ID NO: 1893 - DNA, 20 bp, Artificial sequence
  Synthetic oligonucleotide
cgttggcatttaagtctgag

SEQ ID NO: 1894 - DNA, 20 bp, Artificial sequence
  Synthetic oligonucleotide
ctgggttgagactattcagg

SEQ ID NO: 1895 - DNA, 20 bp, Artificial sequence
  Synthetic oligonucleotide
ccattgaagaaaaacccgcg

SEQ ID NO: 1896 - DNA, 20 bp, Artificial sequence
  Synthetic oligonucleotide
gcactactgtaagggtcatg

SEQ ID NO: 1897 - DNA, 20 bp, Artificial sequence
  Synthetic oligonucleotide
acaagggtagtgttacactg

SEQ ID NO: 1898 - DNA, 20 bp, Artificial sequence
  Synthetic oligonucleotide
caatggtaatcgcatatact

SEQ ID NO: 1899 - DNA, 20 bp, Artificial sequence
  Synthetic oligonucleotide
gactaatcctcttaagttca

SEQ ID NO: 1900 - DNA, 20 bp, Artificial sequence
  Synthetic oligonucleotide
aggtactgtaagccctttgc

SEQ ID NO: 1901 - DNA, 20 bp, Artificial sequence
  Synthetic oligonucleotide
aacttttacacgctagtggg

SEQ ID NO: 1902 - DNA, 20 bp, Artificial sequence
  Synthetic oligonucleotide
ccctttgttcatactgaacg

SEQ ID NO: 1903 - DNA, 20 bp, Artificial sequence
  Synthetic oligonucleotide
agcttccctccaacgagtga

SEQ ID NO: 1904 - DNA, 20 bp, Artificial sequence
  Synthetic oligonucleotide
ggcccaagggaattgatgca

SEQ ID NO: 1905 - DNA, 20 bp, Artificial sequence
  Synthetic oligonucleotide
aggaataggcacttcgggca

SEQ ID NO: 1906 - DNA, 20 bp, Artificial sequence
  Synthetic oligonucleotide
ggaacccaggatttaggtgc

SEQ ID NO: 1907 - DNA, 20 bp, Artificial sequence
  Synthetic oligonucleotide
ggtcataggagtgttagccc

SEQ ID NO: 1908 - DNA, 20 bp, Artificial sequence
  Synthetic oligonucleotide
ggttggattgctttattgca

SEQ ID NO: 1909 - DNA, 20 bp, Artificial sequence
  Synthetic oligonucleotide
gcctgctctcatgtgagagt

SEQ ID NO: 1910 - DNA, 20 bp, Artificial sequence
  Synthetic oligonucleotide
cgcttggctgacatttaggg

SEQ ID NO: 1911 - DNA, 20 bp, Artificial sequence
  Synthetic oligonucleotide
accgagctcaagaactgtga

SEQ ID NO: 1912 - DNA, 20 bp, Artificial sequence
  Synthetic oligonucleotide
tggcctgcttattgcaggcc

SEQ ID NO: 1913 - DNA, 20 bp, Artificial sequence
  Synthetic oligonucleotide
gttttcagttgagaacggta

SEQ ID NO: 1914 - DNA, 20 bp, Artificial sequence
  Synthetic oligonucleotide
gggacctccttatattcacc

SEQ ID NO: 1915 - DNA, 20 bp, Artificial sequence
  Synthetic oligonucleotide
cccctgctttaggatggtgt

SEQ ID NO: 1916 - DNA, 20 bp, Artificial sequence
  Synthetic oligonucleotide
ggtccccccagaaggcttga

SEQ ID NO: 1917 - DNA, 20 bp, Artificial sequence
  Synthetic oligonucleotide
tattcttaccgtctttagga

SEQ ID NO: 1918 - DNA, 20 bp, Artificial sequence
  Synthetic oligonucleotide
ggatggagctgttgtggcat

SEQ ID NO: 1919 - DNA, 20 bp, Artificial sequence
  Synthetic oligonucleotide
gcattaccctacaatgcata

SEQ ID NO: 1920 - DNA, 20 bp, Artificial sequence
  Synthetic oligonucleotide
gcatttgagagttatacacg

SEQ ID NO: 1921 - DNA, 20 bp, Artificial sequence
  Synthetic oligonucleotide
gggccttatagaccatacca

SEQ ID NO: 1922 - DNA, 20 bp, Artificial sequence
  Synthetic oligonucleotide
ggagacaatctagttagacc

SEQ ID NO: 1923 - DNA, 20 bp, Artificial sequence
  Synthetic oligonucleotide
gcacaaatggactgccggcc

SEQ ID NO: 1924 - DNA, 20 bp, Artificial sequence
  Synthetic oligonucleotide
gagagtcatactcctgacag

SEQ ID NO: 1925 - DNA, 20 bp, Artificial sequence
  Synthetic oligonucleotide
ctccgggctcaccacctggt

SEQ ID NO: 1926 - DNA, 20 bp, Artificial sequence
  Synthetic oligonucleotide
tctatacactgctgttgacg

SEQ ID NO: 1927 - DNA, 20 bp, Artificial sequence
  Synthetic oligonucleotide
gcttgctaaacctgtccatt

SEQ ID NO: 1928 - DNA, 20 bp, Artificial sequence
  Synthetic oligonucleotide
ctggatggtataaattgccc

SEQ ID NO: 1929 - DNA, 20 bp, Artificial sequence
  Synthetic oligonucleotide
gttgccgctttggtgaacct

SEQ ID NO: 1930 - DNA, 20 bp, Artificial sequence
  Synthetic oligonucleotide
gtgcactgatacagttgggc

SEQ ID NO: 1931 - DNA, 20 bp, Artificial sequence
  Synthetic oligonucleotide
ccatcaagtaggccagtcac

SEQ ID NO: 1932 - DNA, 20 bp, Artificial sequence
  Synthetic oligonucleotide
ggaataacccatacccccca

SEQ ID NO: 1933 - DNA, 20 bp, Artificial sequence
  Synthetic oligonucleotide
gcatgactcctaattgctgt

SEQ ID NO: 1934 - DNA, 20 bp, Artificial sequence
  Synthetic oligonucleotide
gagctcagtcttcactagtt

SEQ ID NO: 1935 - DNA, 20 bp, Artificial sequence
  Synthetic oligonucleotide
gtcaggcaccagattgctca

SEQ ID NO: 1936 - DNA, 20 bp, Artificial sequence
  Synthetic oligonucleotide
atgatcatactggagccagg

SEQ ID NO: 1937 - DNA, 20 bp, Artificial sequence
  Synthetic oligonucleotide
acctaccagagtggcatcct

SEQ ID NO: 1938 - DNA, 20 bp, Artificial sequence
  Synthetic oligonucleotide
acgctgtgtgaatcaaaagc

SEQ ID NO: 1939 - DNA, 20 bp, Artificial sequence
  Synthetic oligonucleotide
agtgttcttacatccaccgt

SEQ ID NO: 1940 - DNA, 20 bp, Artificial sequence
  Synthetic oligonucleotide
catgccaatcgcatgcaagc

SEQ ID NO: 1941 - DNA, 20 bp, Artificial sequence
  Synthetic oligonucleotide
gtcaggagttaactatgaac

SEQ ID NO: 1942 - DNA, 20 bp, Artificial sequence
  Synthetic oligonucleotide
caccagttaggcctgctccg

SEQ ID NO: 1943 - DNA, 20 bp, Artificial sequence
  Synthetic oligonucleotide
cgtttccacagccaggctta

SEQ ID NO: 1944 - DNA, 20 bp, Artificial sequence
  Synthetic oligonucleotide
agtcttgggtcactaggcac

SEQ ID NO: 1945 - DNA, 20 bp, Artificial sequence
  Synthetic oligonucleotide
ccaatattttgactagttcg

SEQ ID NO: 1946 - DNA, 20 bp, Artificial sequence
  Synthetic oligonucleotide
tttagtatgtcgagaactca

SEQ ID NO: 1947 - DNA, 20 bp, Artificial sequence
  Synthetic oligonucleotide
tgaaacctgtatagtttacc

SEQ ID NO: 1948 - DNA, 20 bp, Artificial sequence
  Synthetic oligonucleotide
ctaaccatagacagagtgca

SEQ ID NO: 1949 - DNA, 20 bp, Artificial sequence
  Synthetic oligonucleotide
catcatgatcttggtaaggc

SEQ ID NO: 1950 - DNA, 20 bp, Artificial sequence
  Synthetic oligonucleotide
gaccccacaatttggtccca

SEQ ID NO: 1951 - DNA, 20 bp, Artificial sequence
  Synthetic oligonucleotide
gactatctcagcactaggga

SEQ ID NO: 1952 - DNA, 20 bp, Artificial sequence
  Synthetic oligonucleotide
gccctgtagtatgtggatac

SEQ ID NO: 1953 - DNA, 20 bp, Artificial sequence
  Synthetic oligonucleotide
ctcgggtatataaattaatg

SEQ ID NO: 1954 - DNA, 20 bp, Artificial sequence
  Synthetic oligonucleotide
ggatctagaatgattggttg

SEQ ID NO: 1955 - DNA, 20 bp, Artificial sequence
  Synthetic oligonucleotide
gggctgctgtttgagtcccc

SEQ ID NO: 1956 - DNA, 20 bp, Artificial sequence
  Synthetic oligonucleotide
agatactcactcgcttttca

SEQ ID NO: 1957 - DNA, 20 bp, Artificial sequence
  Synthetic oligonucleotide
acgctccttcatttcatgca

SEQ ID NO: 1958 - DNA, 20 bp, Artificial sequence
  Synthetic oligonucleotide
gctgtaagtatagatgcctc

SEQ ID NO: 1959 - DNA, 20 bp, Artificial sequence
  Synthetic oligonucleotide
attagttgactctataaacg

SEQ ID NO: 1960 - DNA, 20 bp, Artificial sequence
  Synthetic oligonucleotide
aagtttggtattgacacctc

SEQ ID NO: 1961 - DNA, 20 bp, Artificial sequence
  Synthetic oligonucleotide
cttgatataagggtaatacg

SEQ ID NO: 1962 - DNA, 20 bp, Artificial sequence
  Synthetic oligonucleotide
ggctcaggcaaagtagcttc

SEQ ID NO: 1963 - DNA, 20 bp, Artificial sequence
  Synthetic oligonucleotide
gccatcttcaagactaaggt

SEQ ID NO: 1964 - DNA, 20 bp, Artificial sequence
  Synthetic oligonucleotide
cgaaaaatagtatgcgaagc

SEQ ID NO: 1965 - DNA, 20 bp, Artificial sequence
  Synthetic oligonucleotide
ggagaccctaaaaaacccgt

SEQ ID NO: 1966 - DNA, 20 bp, Artificial sequence
  Synthetic oligonucleotide
cctataggtggccttcagtc

SEQ ID NO: 1967 - DNA, 20 bp, Artificial sequence
  Synthetic oligonucleotide
ggcaagcccagactcatgct

SEQ ID NO: 1968 - DNA, 20 bp, Artificial sequence
  Synthetic oligonucleotide
cgtcaacactatagatgaat

SEQ ID NO: 1969 - DNA, 20 bp, Artificial sequence
  Synthetic oligonucleotide
ccactcatgtacatgagatc

SEQ ID NO: 1970 - DNA, 20 bp, Artificial sequence
  Synthetic oligonucleotide
ggcaagcaactatgggtgga

SEQ ID NO: 1971 - DNA, 20 bp, Artificial sequence
  Synthetic oligonucleotide
gtttacttcgggccaggtcc

SEQ ID NO: 1972 - DNA, 20 bp, Artificial sequence
  Synthetic oligonucleotide
acccctaggaataatgttgc

SEQ ID NO: 1973 - DNA, 20 bp, Artificial sequence
  Synthetic oligonucleotide
agcgatacaaacctacgcca

SEQ ID NO: 1974 - DNA, 20 bp, Artificial sequence
  Synthetic oligonucleotide
ggcaagtttttatcgcttaa

SEQ ID NO: 1975 - DNA, 20 bp, Artificial sequence
  Synthetic oligonucleotide
agtattttagccgggatacg

SEQ ID NO: 1976 - DNA, 20 bp, Artificial sequence
  Synthetic oligonucleotide
acgggttcctatttgtcagg

SEQ ID NO: 1977 - DNA, 20 bp, Artificial sequence
  Synthetic oligonucleotide
gtgagctttactctgcaata

SEQ ID NO: 1978 - DNA, 20 bp, Artificial sequence
  Synthetic oligonucleotide
gccttattggagagagaact

SEQ ID NO: 1979 - DNA, 20 bp, Artificial sequence
  Synthetic oligonucleotide
tcagtgctacccattagacc

SEQ ID NO: 1980 - DNA, 20 bp, Artificial sequence
  Synthetic oligonucleotide
catacatggaggagtccctg

SEQ ID NO: 1981 - DNA, 20 bp, Artificial sequence
  Synthetic oligonucleotide
tcctaaggatgtagcccatc

SEQ ID NO: 1982 - DNA, 20 bp, Artificial sequence
  Synthetic oligonucleotide
cgcatccagttaatctctga

SEQ ID NO: 1983 - DNA, 20 bp, Artificial sequence
  Synthetic oligonucleotide
gtcccagttggattaaggtg

SEQ ID NO: 1984 - DNA, 20 bp, Artificial sequence
  Synthetic oligonucleotide
ctgtacaggagggtgtctct

SEQ ID NO: 1985 - DNA, 20 bp, Artificial sequence
  Synthetic oligonucleotide
tagtctaaggcagtcagggt

SEQ ID NO: 1986 - DNA, 20 bp, Artificial sequence
  Synthetic oligonucleotide
atctagactctgcctggtta

SEQ ID NO: 1987 - DNA, 20 bp, Artificial sequence
  Synthetic oligonucleotide
ggacactctcgctgaggaca

SEQ ID NO: 1988 - DNA, 20 bp, Artificial sequence
  Synthetic oligonucleotide
ggcactatgaccacagggta

SEQ ID NO: 1989 - DNA, 20 bp, Artificial sequence
  Synthetic oligonucleotide
tctgctctgttagccgagca

SEQ ID NO: 1990 - DNA, 20 bp, Artificial sequence
  Synthetic oligonucleotide
gcacaatgcttgtatgcccc

SEQ ID NO: 1991 - DNA, 20 bp, Artificial sequence
  Synthetic oligonucleotide
gtgcccttactgttaaatcc

SEQ ID NO: 1992 - DNA, 20 bp, Artificial sequence
  Synthetic oligonucleotide
tttgctcaggatcgctggcc

SEQ ID NO: 1993 - DNA, 20 bp, Artificial sequence
  Synthetic oligonucleotide
agcctctgcctaaaggtagt

SEQ ID NO: 1994 - DNA, 20 bp, Artificial sequence
  Synthetic oligonucleotide
cgtgattgcaaagtccaagg

SEQ ID NO: 1995 - DNA, 20 bp, Artificial sequence
  Synthetic oligonucleotide
cagtagtggtatcaaatctg

SEQ ID NO: 1996 - DNA, 20 bp, Artificial sequence
  Synthetic oligonucleotide
tccagcacatagaccatagc

SEQ ID NO: 1997 - DNA, 20 bp, Artificial sequence
  Synthetic oligonucleotide
ggtggaaagtctagtatgtc

SEQ ID NO: 1998 - DNA, 20 bp, Artificial sequence
  Synthetic oligonucleotide
gacccatggaaagactcggg

SEQ ID NO: 1999 - DNA, 20 bp, Artificial sequence
  Synthetic oligonucleotide
gtttcccataggccacgctg

SEQ ID NO: 2000 - DNA, 20 bp, Artificial sequence
  Synthetic oligonucleotide
agtggttgctatcctgctaa

SEQ ID NO: 2001 - DNA, 20 bp, Artificial sequence
  Synthetic oligonucleotide
acgcaagtcctcctccgggc

SEQ ID NO: 2002 - DNA, 20 bp, Artificial sequence
  Synthetic oligonucleotide
tcaagggaactaactcctcc

SEQ ID NO: 2003 - DNA, 20 bp, Artificial sequence
  Synthetic oligonucleotide
gattgatcatgttatgccct

SEQ ID NO: 2004 - DNA, 20 bp, Artificial sequence
  Synthetic oligonucleotide
ggtggattggagttgctaca

SEQ ID NO: 2005 - DNA, 20 bp, Artificial sequence
  Synthetic oligonucleotide
tgggacacatatgttgccgc

SEQ ID NO: 2006 - DNA, 20 bp, Artificial sequence
  Synthetic oligonucleotide
ctgaagcaaagcttataggc

SEQ ID NO: 2007 - DNA, 20 bp, Artificial sequence
  Synthetic oligonucleotide
tgacactgagtaatctgcga

SEQ ID NO: 2008 - DNA, 20 bp, Artificial sequence
  Synthetic oligonucleotide
tgtaagattcccccaagggt

SEQ ID NO: 2009 - DNA, 20 bp, Artificial sequence
  Synthetic oligonucleotide
ggtgggattacatctcttat

SEQ ID NO: 2010 - DNA, 20 bp, Artificial sequence
  Synthetic oligonucleotide
cgtgatattcatgttgtctg

SEQ ID NO: 2011 - DNA, 20 bp, Artificial sequence
  Synthetic oligonucleotide
cgaagccaaaggtacttgag

SEQ ID NO: 2012 - DNA, 20 bp, Artificial sequence
  Synthetic oligonucleotide
gcttgcactccatcatataa

SEQ ID NO: 2013 - DNA, 20 bp, Artificial sequence
  Synthetic oligonucleotide
aggaccagccagtctagttt

SEQ ID NO: 2014 - DNA, 20 bp, Artificial sequence
  Synthetic oligonucleotide
ggtctcacgctgtgtgaatc

SEQ ID NO: 2015 - DNA, 20 bp, Artificial sequence
  Synthetic oligonucleotide
ggagtcaagttggttaatag

SEQ ID NO: 2016 - DNA, 20 bp, Artificial sequence
  Synthetic oligonucleotide
gggcgaaagtatatcaggca

SEQ ID NO: 2017 - DNA, 20 bp, Artificial sequence
  Synthetic oligonucleotide
ggctgtcaatgctgatatat

SEQ ID NO: 2018 - DNA, 20 bp, Artificial sequence
  Synthetic oligonucleotide
ggagttcaccagttaggcct

SEQ ID NO: 2019 - DNA, 20 bp, Artificial sequence
  Synthetic oligonucleotide
accctcccaacaaataagcg

SEQ ID NO: 2020 - DNA, 20 bp, Artificial sequence
  Synthetic oligonucleotide
agcaagtcttgggtcactag

SEQ ID NO: 2021 - DNA, 20 bp, Artificial sequence
  Synthetic oligonucleotide
ggcatcaatcaacaagcacc

SEQ ID NO: 2022 - DNA, 20 bp, Artificial sequence
  Synthetic oligonucleotide
gctttagtatgtcgagaact

SEQ ID NO: 2023 - DNA, 20 bp, Artificial sequence
  Synthetic oligonucleotide
gtggatggtatcctggtcaa

SEQ ID NO: 2024 - DNA, 20 bp, Artificial sequence
  Synthetic oligonucleotide
gcatgattctaaccatagac

SEQ ID NO: 2025 - DNA, 20 bp, Artificial sequence
  Synthetic oligonucleotide
gtactcatcatgatcttggt

SEQ ID NO: 2026 - DNA, 20 bp, Artificial sequence
  Synthetic oligonucleotide
ggaatagggctctgcttatt

SEQ ID NO: 2027 - DNA, 20 bp, Artificial sequence
  Synthetic oligonucleotide
cctcgaggatagtttcactg

SEQ ID NO: 2028 - DNA, 20 bp, Artificial sequence
  Synthetic oligonucleotide
catctcgggtatataaatta

SEQ ID NO: 2029 - DNA, 20 bp, Artificial sequence
  Synthetic oligonucleotide
tgttggatctagaatgattg

SEQ ID NO: 2030 - DNA, 20 bp, Artificial sequence
  Synthetic oligonucleotide
gtatgggctgctgtttgagt

SEQ ID NO: 2031 - DNA, 20 bp, Artificial sequence
  Synthetic oligonucleotide
ctgcagagatactcactcgc

SEQ ID NO: 2032 - DNA, 20 bp, Artificial sequence
  Synthetic oligonucleotide
ttgatacgctccttcatttc

SEQ ID NO: 2033 - DNA, 20 bp, Artificial sequence
  Synthetic oligonucleotide
atgctgtaagtatagatgcc

SEQ ID NO: 2034 - DNA, 20 bp, Artificial sequence
  Synthetic oligonucleotide
cgttgaatattagttgactc

SEQ ID NO: 2035 - DNA, 20 bp, Artificial sequence
  Synthetic oligonucleotide
ggtgttgtatgataatgtgt

SEQ ID NO: 2036 - DNA, 20 bp, Artificial sequence
  Synthetic oligonucleotide
caatagtagtgatgacttcc

SEQ ID NO: 2037 - DNA, 20 bp, Artificial sequence
  Synthetic oligonucleotide
agatggagcttgagccatcc

SEQ ID NO: 2038 - DNA, 20 bp, Artificial sequence
  Synthetic oligonucleotide
gccccacagtagaaatgtgg

SEQ ID NO: 2039 - DNA, 20 bp, Artificial sequence
  Synthetic oligonucleotide
agtcaacaagacaactcgat

SEQ ID NO: 2040 - DNA, 20 bp, Artificial sequence
  Synthetic oligonucleotide
cgttattcagtctcagggag

SEQ ID NO: 2041 - DNA, 20 bp, Artificial sequence
  Synthetic oligonucleotide
ctttcacctataggtggcct

SEQ ID NO: 2042 - DNA, 20 bp, Artificial sequence
  Synthetic oligonucleotide
gagtaatggacttctggtct

SEQ ID NO: 2043 - DNA, 20 bp, Artificial sequence
  Synthetic oligonucleotide
gtgtgagggaatctaagatc

SEQ ID NO: 2044 - DNA, 20 bp, Artificial sequence
  Synthetic oligonucleotide
ggtgccacaccatcaaaaga

SEQ ID NO: 2045 - DNA, 20 bp, Artificial sequence
  Synthetic oligonucleotide
gctgcagtggtaccacagac

SEQ ID NO: 2046 - DNA, 20 bp, Artificial sequence
  Synthetic oligonucleotide
aagaagtttacttcgggcca

SEQ ID NO: 2047 - DNA, 20 bp, Artificial sequence
  Synthetic oligonucleotide
tcgggagttgttagtccaag

SEQ ID NO: 2048 - DNA, 20 bp, Artificial sequence
  Synthetic oligonucleotide
gctcccaaacaactaatagt

SEQ ID NO: 2049 - DNA, 20 bp, Artificial sequence
  Synthetic oligonucleotide
tcaaaatcacgaaaggcggg

SEQ ID NO: 2050 - DNA, 20 bp, Artificial sequence
  Synthetic oligonucleotide
ttagaagtattttagccggg

SEQ ID NO: 2051 - DNA, 20 bp, Artificial sequence
  Synthetic oligonucleotide
ggtaggtaactacgggttcc

SEQ ID NO: 2052 - DNA, 20 bp, Artificial sequence
  Synthetic oligonucleotide
cacccctgtaaacagtgagc

SEQ ID NO: 2053 - DNA, 20 bp, Artificial sequence
  Synthetic oligonucleotide
ctgctcaagccttattggag

SEQ ID NO: 2054 - DNA, 20 bp, Artificial sequence
  Synthetic oligonucleotide
gtggaatcagtgctacccat

SEQ ID NO: 2055 - DNA, 20 bp, Artificial sequence
  Synthetic oligonucleotide
agctgggcactcatacatac

SEQ ID NO: 2056 - DNA, 20 bp, Artificial sequence
  Synthetic oligonucleotide
agcctcctaaggatgtagcc

SEQ ID NO: 2057 - DNA, 20 bp, Artificial sequence
  Synthetic oligonucleotide
atggtcctcgcatccagtta

SEQ ID NO: 2058 - DNA, 20 bp, Artificial sequence
  Synthetic oligonucleotide
cagcactgtcccagttggat

SEQ ID NO: 2059 - DNA, 20 bp, Artificial sequence
  Synthetic oligonucleotide
gttgattcactgcacactgt

SEQ ID NO: 2060 - DNA, 20 bp, Artificial sequence
  Synthetic oligonucleotide
ggtatattagtctaaggcag

SEQ ID NO: 2061 - DNA, 20 bp, Artificial sequence
  Synthetic oligonucleotide
gcgaagccttctcaaagact

SEQ ID NO: 2062 - DNA, 20 bp, Artificial sequence
  Synthetic oligonucleotide
gggccgcctctgttattgtg

SEQ ID NO: 2063 - DNA, 20 bp, Artificial sequence
  Synthetic oligonucleotide
gaactgtgggcactatgacc

SEQ ID NO: 2064 - DNA, 20 bp, Artificial sequence
  Synthetic oligonucleotide
cctttggagctttgactggc

SEQ ID NO: 2065 - DNA, 20 bp, Artificial sequence
  Synthetic oligonucleotide
cgatttcctgccagtggctg

SEQ ID NO: 2066 - DNA, 20 bp, Artificial sequence
  Synthetic oligonucleotide
ctactgtgcccttactgtta

SEQ ID NO: 2067 - DNA, 20 bp, Artificial sequence
  Synthetic oligonucleotide
gaagacttaggtctcaagct

SEQ ID NO: 2068 - DNA, 20 bp, Artificial sequence
  Synthetic oligonucleotide
gtagtcatgtagaacagcac

SEQ ID NO: 2069 - DNA, 20 bp, Artificial sequence
  Synthetic oligonucleotide
ccaccgtgattgcaaagtcc

SEQ ID NO: 2070 - DNA, 20 bp, Artificial sequence
  Synthetic oligonucleotide
gggcacagtagtggtatcaa

SEQ ID NO: 2071 - DNA, 20 bp, Artificial sequence
  Synthetic oligonucleotide
agagctgtcctaaggcaatt

SEQ ID NO: 2072 - DNA, 20 bp, Artificial sequence
  Synthetic oligonucleotide
cttgacatacaggataggtg

SEQ ID NO: 2073 - DNA, 20 bp, Artificial sequence
  Synthetic oligonucleotide
ttggtaaattagacccatgg

SEQ ID NO: 2074 - DNA, 20 bp, Artificial sequence
  Synthetic oligonucleotide
gatgtatgtttcccataggc

SEQ ID NO: 2075 - DNA, 20 bp, Artificial sequence
  Synthetic oligonucleotide
aagggtcttagtgccaaata

SEQ ID NO: 2076 - DNA, 20 bp, Artificial sequence
  Synthetic oligonucleotide
atgctagtcactcattgaga

SEQ ID NO: 2077 - DNA, 20 bp, Artificial sequence
  Synthetic oligonucleotide
tgatccattagataggctat

SEQ ID NO: 2078 - DNA, 20 bp, Artificial sequence
  Synthetic oligonucleotide
tctcacgctgtgtgaatcaa

SEQ ID NO: 2079 - DNA, 20 bp, Artificial sequence
  Synthetic oligonucleotide
agggaagtctaggtctcacg

SEQ ID NO: 2080 - DNA, 20 bp, Artificial sequence
  Synthetic oligonucleotide
gacccttatggagacttata

SEQ ID NO: 2081 - DNA, 20 bp, Artificial sequence
  Synthetic oligonucleotide
gtggactccacacacctact

SEQ ID NO: 2082 - DNA, 20 bp, Artificial sequence
  Synthetic oligonucleotide
gcaagcaaagactacaccgt

SEQ ID NO: 2083 - DNA, 20 bp, Artificial sequence
  Synthetic oligonucleotide
atattccctatccagggtag

SEQ ID NO: 2084 - DNA, 20 bp, Artificial sequence
  Synthetic oligonucleotide
aggtgtatattccctatcca

SEQ ID NO: 2085 - DNA, 20 bp, Artificial sequence
  Synthetic oligonucleotide
tgatattgcagtgggatggc

SEQ ID NO: 2086 - DNA, 20 bp, Artificial sequence
  Synthetic oligonucleotide
gcatggttatctaatgcatc

SEQ ID NO: 2087 - DNA, 20 bp, Artificial sequence
  Synthetic oligonucleotide
gagggatccccaaatagagc

SEQ ID NO: 2088 - DNA, 20 bp, Artificial sequence
  Synthetic oligonucleotide
atcacagttgcttgaccctt

SEQ ID NO: 2089 - DNA, 20 bp, Artificial sequence
  Synthetic oligonucleotide
tgatctattatgagggcatc

SEQ ID NO: 2090 - DNA, 20 bp, Artificial sequence
  Synthetic oligonucleotide
ttccctaatatagggcagat

SEQ ID NO: 2091 - DNA, 20 bp, Artificial sequence
  Synthetic oligonucleotide
ctataggacctcaggagatt

SEQ ID NO: 2092 - DNA, 20 bp, Artificial sequence
  Synthetic oligonucleotide
ctcaagacctataggacctc

SEQ ID NO: 2093 - DNA, 20 bp, Artificial sequence
  Synthetic oligonucleotide
tagtgtggatggtatcctgg

SEQ ID NO: 2094 - DNA, 20 bp, Artificial sequence
  Synthetic oligonucleotide
tagggtggttggttcaaaat

SEQ ID NO: 2095 - DNA, 20 bp, Artificial sequence
  Synthetic oligonucleotide
cacacatataggctagccaa

SEQ ID NO: 2096 - DNA, 20 bp, Artificial sequence
  Synthetic oligonucleotide
tgggttactttccaatagag

SEQ ID NO: 2097 - DNA, 20 bp, Artificial sequence
  Synthetic oligonucleotide
cttaggtagttcacaactct

SEQ ID NO: 2098 - DNA, 20 bp, Artificial sequence
  Synthetic oligonucleotide
cctgtagtatgtggatactg

SEQ ID NO: 2099 - DNA, 20 bp, Artificial sequence
  Synthetic oligonucleotide
ggatggtgtgtatgttatga

SEQ ID NO: 2100 - DNA, 20 bp, Artificial sequence
  Synthetic oligonucleotide
gtagtctattggtgttcctt

SEQ ID NO: 2101 - DNA, 20 bp, Artificial sequence
  Synthetic oligonucleotide
atacgctccttcatttcatg

SEQ ID NO: 2102 - DNA, 20 bp, Artificial sequence
  Synthetic oligonucleotide
gaattcaatggacccacatg

SEQ ID NO: 2103 - DNA, 20 bp, Artificial sequence
  Synthetic oligonucleotide
gggtaggattcatggtccaa

SEQ ID NO: 2104 - DNA, 20 bp, Artificial sequence
  Synthetic oligonucleotide
taatagactgcgattataca

SEQ ID NO: 2105 - DNA, 20 bp, Artificial sequence
  Synthetic oligonucleotide
ggcctaatctatgctgggcc

SEQ ID NO: 2106 - DNA, 20 bp, Artificial sequence
  Synthetic oligonucleotide
tgagattaggcctaatctat

SEQ ID NO: 2107 - DNA, 20 bp, Artificial sequence
  Synthetic oligonucleotide
gattaggtatggaggccatg

SEQ ID NO: 2108 - DNA, 20 bp, Artificial sequence
  Synthetic oligonucleotide
ccccaatacagattcagtgg

SEQ ID NO: 2109 - DNA, 20 bp, Artificial sequence
  Synthetic oligonucleotide
tcaaggtagccccaatacag

SEQ ID NO: 2110 - DNA, 20 bp, Artificial sequence
  Synthetic oligonucleotide
caagaggtactgtaagccct

SEQ ID NO: 2111 - DNA, 20 bp, Artificial sequence
  Synthetic oligonucleotide
tgttttgacctaactggcct

SEQ ID NO: 2112 - DNA, 20 bp, Artificial sequence
  Synthetic oligonucleotide
gctaagagtcacctgtatcc

SEQ ID NO: 2113 - DNA, 20 bp, Artificial sequence
  Synthetic oligonucleotide
aaggtattaaggcccttggc

SEQ ID NO: 2114 - DNA, 20 bp, Artificial sequence
  Synthetic oligonucleotide
ggtgatcagctcaacacccc

SEQ ID NO: 2115 - DNA, 20 bp, Artificial sequence
  Synthetic oligonucleotide
aggagtgttagcccaggtga

SEQ ID NO: 2116 - DNA, 20 bp, Artificial sequence
  Synthetic oligonucleotide
gggtcataggagtgttagcc

SEQ ID NO: 2117 - DNA, 20 bp, Artificial sequence
  Synthetic oligonucleotide
aaggtgatgacacccctacc

SEQ ID NO: 2118 - DNA, 20 bp, Artificial sequence
  Synthetic oligonucleotide
agctatttcattaagtcacc

SEQ ID NO: 2119 - DNA, 20 bp, Artificial sequence
  Synthetic oligonucleotide
gtatattagtctaaggcagt

SEQ ID NO: 2120 - DNA, 20 bp, Artificial sequence
  Synthetic oligonucleotide
tattatcttcttagggtcga

SEQ ID NO: 2121 - DNA, 20 bp, Artificial sequence
  Synthetic oligonucleotide
tgtgtaccgagctcaagaac

SEQ ID NO: 2122 - DNA, 20 bp, Artificial sequence
  Synthetic oligonucleotide
agtctgtctctgtgtaccga

SEQ ID NO: 2123 - DNA, 20 bp, Artificial sequence
  Synthetic oligonucleotide
gacactctcgctgaggacac

SEQ ID NO: 2124 - DNA, 20 bp, Artificial sequence
  Synthetic oligonucleotide
gccgcctctgttattgtgat

SEQ ID NO: 2125 - DNA, 20 bp, Artificial sequence
  Synthetic oligonucleotide
aaattgggccgcctctgtta

SEQ ID NO: 2126 - DNA, 20 bp, Artificial sequence
  Synthetic oligonucleotide
ctgtaggttgacaggacatg

SEQ ID NO: 2127 - DNA, 20 bp, Artificial sequence
  Synthetic oligonucleotide
tgagggtgcttagtgaactg

SEQ ID NO: 2128 - DNA, 20 bp, Artificial sequence
  Synthetic oligonucleotide
gagtctgtctttagggtcac

SEQ ID NO: 2129 - DNA, 20 bp, Artificial sequence
  Synthetic oligonucleotide
cgatacctgcttttgtgaca

SEQ ID NO: 2130 - DNA, 20 bp, Artificial sequence
  Synthetic oligonucleotide
atagccattcgatacctgct

SEQ ID NO: 2131 - DNA, 20 bp, Artificial sequence
  Synthetic oligonucleotide
actgcaggatagccattcga

SEQ ID NO: 2132 - DNA, 20 bp, Artificial sequence
  Synthetic oligonucleotide
tatgaatgccaccgtgattg

SEQ ID NO: 2133 - DNA, 20 bp, Artificial sequence
  Synthetic oligonucleotide
aactacataggcactctact

SEQ ID NO: 2134 - DNA, 20 bp, Artificial sequence
  Synthetic oligonucleotide
aacattcagctagactagtt

SEQ ID NO: 2135 - DNA, 20 bp, Artificial sequence
  Synthetic oligonucleotide
atgagaccccacaatttggt

SEQ ID NO: 2136 - DNA, 20 bp, Artificial sequence
  Synthetic oligonucleotide
atagaggccctcttgtttca

SEQ ID NO: 2137 - DNA, 20 bp, Artificial sequence
  Synthetic oligonucleotide
caattgtcagacttattgag

SEQ ID NO: 2138 - DNA, 20 bp, Artificial sequence
  Synthetic oligonucleotide
gaactcccacaaggtactct

SEQ ID NO: 2139 - DNA, 20 bp, Artificial sequence
  Synthetic oligonucleotide
ctgtagtatgcattgacaag

SEQ ID NO: 2140 - DNA, 20 bp, Artificial sequence
  Synthetic oligonucleotide
tactagggccagagaatcca

SEQ ID NO: 2141 - DNA, 20 bp, Artificial sequence
  Synthetic oligonucleotide
aagccactcatgtacatgag

SEQ ID NO: 2142 - DNA, 20 bp, Artificial sequence
  Synthetic oligonucleotide
aaactgggttgagactattc

SEQ ID NO: 2143 - DNA, 20 bp, Artificial sequence
  Synthetic oligonucleotide
ctgcagtggtaccacagacc

SEQ ID NO: 2144 - DNA, 20 bp, Artificial sequence
  Synthetic oligonucleotide
tgactacacatcttgtatac

SEQ ID NO: 2145 - DNA, 20 bp, Artificial sequence
  Synthetic oligonucleotide
ctaggcagctctttgtaggc

SEQ ID NO: 2146 - DNA, 20 bp, Artificial sequence
  Synthetic oligonucleotide
ccctataggtcaaaaatgcc

SEQ ID NO: 2147 - DNA, 20 bp, Artificial sequence
  Synthetic oligonucleotide
tcagtcaggtacaggtgttg

SEQ ID NO: 2148 - DNA, 20 bp, Artificial sequence
  Synthetic oligonucleotide
gtcaaagacctgtgagggtg

SEQ ID NO: 2149 - DNA, 20 bp, Artificial sequence
  Synthetic oligonucleotide
ggtctttgcagttaagttat

SEQ ID NO: 2150 - DNA, 20 bp, Artificial sequence
  Synthetic oligonucleotide
gggtcttagtgccaaatatc

SEQ ID NO: 2151 - DNA, 20 bp, Artificial sequence
  Synthetic oligonucleotide
gaagtctaggtctcacgctg

SEQ ID NO: 2152 - DNA, 20 bp, Artificial sequence
  Synthetic oligonucleotide
tacataggcactctactagc

SEQ ID NO: 2153 - DNA, 20 bp, Artificial sequence
  Synthetic oligonucleotide
cccttatggagacttatata

SEQ ID NO: 2154 - DNA, 20 bp, Artificial sequence
  Synthetic oligonucleotide
tgaagatttgacccttatgg

SEQ ID NO: 2155 - DNA, 20 bp, Artificial sequence
  Synthetic oligonucleotide
aagcaaagactacaccgtga

SEQ ID NO: 2156 - DNA, 20 bp, Artificial sequence
  Synthetic oligonucleotide
atccagggtagaagactagc

SEQ ID NO: 2157 - DNA, 20 bp, Artificial sequence
  Synthetic oligonucleotide
gtgtatattccctatccagg

SEQ ID NO: 2158 - DNA, 20 bp, Artificial sequence
  Synthetic oligonucleotide
ggatggctgtcaatgctgat

SEQ ID NO: 2159 - DNA, 20 bp, Artificial sequence
  Synthetic oligonucleotide
acaagtctactaccaataag

SEQ ID NO: 2160 - DNA, 20 bp, Artificial sequence
  Synthetic oligonucleotide
attctcatcatcgatccaaa

SEQ ID NO: 2161 - DNA, 20 bp, Artificial sequence
  Synthetic oligonucleotide
cacagttgcttgacccttaa

SEQ ID NO: 2162 - DNA, 20 bp, Artificial sequence
  Synthetic oligonucleotide
gattcaatagtgtaggtgac

SEQ ID NO: 2163 - DNA, 20 bp, Artificial sequence
  Synthetic oligonucleotide
cctaatatagggcagatgat

SEQ ID NO: 2164 - DNA, 20 bp, Artificial sequence
  Synthetic oligonucleotide
aggacctcaggagattgtac

SEQ ID NO: 2165 - DNA, 20 bp, Artificial sequence
  Synthetic oligonucleotide
caagacctataggacctcag

SEQ ID NO: 2166 - DNA, 20 bp, Artificial sequence
  Synthetic oligonucleotide
agactatcctggtatgactg

SEQ ID NO: 2167 - DNA, 20 bp, Artificial sequence
  Synthetic oligonucleotide
tgattgactacttcaacctg

SEQ ID NO: 2168 - DNA, 20 bp, Artificial sequence
  Synthetic oligonucleotide
cgtttatagggtggttggtt

SEQ ID NO: 2169 - DNA, 20 bp, Artificial sequence
  Synthetic oligonucleotide
cagctagactagttgaaatc

SEQ ID NO: 2170 - DNA, 20 bp, Artificial sequence
  Synthetic oligonucleotide
gagaccccacaatttggtcc

SEQ ID NO: 2171 - DNA, 20 bp, Artificial sequence
  Synthetic oligonucleotide
aggcagttgtgatagtcaac

SEQ ID NO: 2172 - DNA, 20 bp, Artificial sequence
  Synthetic oligonucleotide
ccattcagcacttaggtagt

SEQ ID NO: 2173 - DNA, 20 bp, Artificial sequence
  Synthetic oligonucleotide
tatgccctgtagtatgtgga

SEQ ID NO: 2174 - DNA, 20 bp, Artificial sequence
  Synthetic oligonucleotide
ttttattggtcatctcgggt

SEQ ID NO: 2175 - DNA, 20 bp, Artificial sequence
  Synthetic oligonucleotide
tcagacttattgaggatggt

SEQ ID NO: 2176 - DNA, 20 bp, Artificial sequence
  Synthetic oligonucleotide
actggtaggatctatggcag

SEQ ID NO: 2177 - DNA, 20 bp, Artificial sequence
  Synthetic oligonucleotide
cacagagtagtctattggtg

SEQ ID NO: 2178 - DNA, 20 bp, Artificial sequence
  Synthetic oligonucleotide
gtctccctcttagtgattgg

SEQ ID NO: 2179 - DNA, 20 bp, Artificial sequence
  Synthetic oligonucleotide
agtggttgccttagtattac

SEQ ID NO: 2180 - DNA, 20 bp, Artificial sequence
  Synthetic oligonucleotide
tgtaaatggcctgactaggc

SEQ ID NO: 2181 - DNA, 20 bp, Artificial sequence
  Synthetic oligonucleotide
ctaggaccagttggttcact

SEQ ID NO: 2182 - DNA, 20 bp, Artificial sequence
  Synthetic oligonucleotide
aatggaccacctaagacctc

SEQ ID NO: 2183 - DNA, 20 bp, Artificial sequence
  Synthetic oligonucleotide
taatctatgctgggccccaa

SEQ ID NO: 2184 - DNA, 20 bp, Artificial sequence
  Synthetic oligonucleotide
agattaggcctaatctatgc

SEQ ID NO: 2185 - DNA, 20 bp, Artificial sequence
  Synthetic oligonucleotide
gaccctcatcactttttgac

SEQ ID NO: 2186 - DNA, 20 bp, Artificial sequence
  Synthetic oligonucleotide
gcccggcaagagattcactt

SEQ ID NO: 2187 - DNA, 20 bp, Artificial sequence
  Synthetic oligonucleotide
aggtagccccaatacagatt

SEQ ID NO: 2188 - DNA, 20 bp, Artificial sequence
  Synthetic oligonucleotide
agggccatgttaaaggcctc

SEQ ID NO: 2189 - DNA, 20 bp, Artificial sequence
  Synthetic oligonucleotide
gacctaactggcctttgggt

SEQ ID NO: 2190 - DNA, 20 bp, Artificial sequence
  Synthetic oligonucleotide
tatgtggaatcagtgctacc

SEQ ID NO: 2191 - DNA, 20 bp, Artificial sequence
  Synthetic oligonucleotide
tatacaaggtattaaggccc

SEQ ID NO: 2192 - DNA, 20 bp, Artificial sequence
  Synthetic oligonucleotide
gcagctctttgtaggcccaa

SEQ ID NO: 2193 - DNA, 20 bp, Artificial sequence
  Synthetic oligonucleotide
gactaataggcctttctaca

SEQ ID NO: 2194 - DNA, 20 bp, Artificial sequence
  Synthetic oligonucleotide
gagtgttagcccaggtgatc

SEQ ID NO: 2195 - DNA, 20 bp, Artificial sequence
  Synthetic oligonucleotide
tcataggagtgttagcccag

SEQ ID NO: 2196 - DNA, 20 bp, Artificial sequence
  Synthetic oligonucleotide
gtgatgacacccctaccatg

SEQ ID NO: 2197 - DNA, 20 bp, Artificial sequence
  Synthetic oligonucleotide
gattaaggtgatgacacccc

SEQ ID NO: 2198 - DNA, 20 bp, Artificial sequence
  Synthetic oligonucleotide
caccaaccttaaatagtagg

SEQ ID NO: 2199 - DNA, 20 bp, Artificial sequence
  Synthetic oligonucleotide
tattagtctaaggcagtcag

SEQ ID NO: 2200 - DNA, 20 bp, Artificial sequence
  Synthetic oligonucleotide
ggagccttacgcttggctga

SEQ ID NO: 2201 - DNA, 20 bp, Artificial sequence
  Synthetic oligonucleotide
tgtaccgagctcaagaactg

SEQ ID NO: 2202 - DNA, 20 bp, Artificial sequence
  Synthetic oligonucleotide
tgtctctgtgtaccgagctc

SEQ ID NO: 2203 - DNA, 20 bp, Artificial sequence
  Synthetic oligonucleotide
cactctcgctgaggacacat

SEQ ID NO: 2204 - DNA, 20 bp, Artificial sequence
  Synthetic oligonucleotide
cgcctctgttattgtgatat

SEQ ID NO: 2205 - DNA, 20 bp, Artificial sequence
  Synthetic oligonucleotide
attgggccgcctctgttatt

SEQ ID NO: 2206 - DNA, 20 bp, Artificial sequence
  Synthetic oligonucleotide
tgtagaaattgggccgcctc

SEQ ID NO: 2207 - DNA, 20 bp, Artificial sequence
  Synthetic oligonucleotide
gtaggttgacaggacatgct

SEQ ID NO: 2208 - DNA, 20 bp, Artificial sequence
  Synthetic oligonucleotide
gggtgcttagtgaactgtgg

SEQ ID NO: 2209 - DNA, 20 bp, Artificial sequence
  Synthetic oligonucleotide
agacctgtgagggtgcttag

SEQ ID NO: 2210 - DNA, 20 bp, Artificial sequence
  Synthetic oligonucleotide
gtctaccagggtggtattat

SEQ ID NO: 2211 - DNA, 20 bp, Artificial sequence
  Synthetic oligonucleotide
tatatactccaggttgtgga

SEQ ID NO: 2212 - DNA, 20 bp, Artificial sequence
  Synthetic oligonucleotide
agccattcgatacctgcttt

SEQ ID NO: 2213 - DNA, 20 bp, Artificial sequence
  Synthetic oligonucleotide
gcaggatagccattcgatac

SEQ ID NO: 2214 - DNA, 20 bp, Artificial sequence
  Synthetic oligonucleotide
gaatgccaccgtgattgcaa

SEQ ID NO: 2215 - DNA, 20 bp, Artificial sequence
  Synthetic oligonucleotide
gcacatagaccatagctgaa

SEQ ID NO: 2216 - DNA, 20 bp, Artificial sequence
  Synthetic oligonucleotide
caatagaatagtgccagtag

SEQ ID NO: 2217 - DNA, 20 bp, Artificial sequence
  Synthetic oligonucleotide
tgatcatactggagccaggt

SEQ ID NO: 2218 - DNA, 20 bp, Artificial sequence
  Synthetic oligonucleotide
cacgctgtgtgaatcaaaag

SEQ ID NO: 2219 - DNA, 20 bp, Artificial sequence
  Synthetic oligonucleotide
gtgtttatccaaaccaaggg

SEQ ID NO: 2220 - DNA, 20 bp, Artificial sequence
  Synthetic oligonucleotide
ctcccacaaggtactcttgc

SEQ ID NO: 2221 - DNA, 20 bp, Artificial sequence
  Synthetic oligonucleotide
ggatgtcagttcagatgaac

SEQ ID NO: 2222 - DNA, 20 bp, Artificial sequence
  Synthetic oligonucleotide
caacatagatcctctgttag

SEQ ID NO: 2223 - DNA, 20 bp, Artificial sequence
  Synthetic oligonucleotide
ctgctccctaagcttagata

SEQ ID NO: 2224 - DNA, 20 bp, Artificial sequence
  Synthetic oligonucleotide
agtaaagagccacctaaggg

SEQ ID NO: 2225 - DNA, 20 bp, Artificial sequence
  Synthetic oligonucleotide
ggtcttagtgccaaatatcc

SEQ ID NO: 2226 - DNA, 20 bp, Artificial sequence
  Synthetic oligonucleotide
aatagtgccagtaggactta

SEQ ID NO: 2227 - DNA, 20 bp, Artificial sequence
  Synthetic oligonucleotide
caagtatgctagtcactcat

SEQ ID NO: 2228 - DNA, 20 bp, Artificial sequence
  Synthetic oligonucleotide
tctaggtctcacgctgtgtg

SEQ ID NO: 2229 - DNA, 20 bp, Artificial sequence
  Synthetic oligonucleotide
atagtgttcttacatccacc

SEQ ID NO: 2230 - DNA, 20 bp, Artificial sequence
  Synthetic oligonucleotide
ccttatggagacttatatac

SEQ ID NO: 2231 - DNA, 20 bp, Artificial sequence
  Synthetic oligonucleotide
gaagatttgacccttatgga

SEQ ID NO: 2232 - DNA, 20 bp, Artificial sequence
  Synthetic oligonucleotide
agcaaagactacaccgtgac

SEQ ID NO: 2233 - DNA, 20 bp, Artificial sequence
  Synthetic oligonucleotide
tgtatattccctatccaggg

SEQ ID NO: 2234 - DNA, 20 bp, Artificial sequence
  Synthetic oligonucleotide
gatggctgtcaatgctgata

SEQ ID NO: 2235 - DNA, 20 bp, Artificial sequence
  Synthetic oligonucleotide
tcatcatcgatccaaacaag

SEQ ID NO: 2236 - DNA, 20 bp, Artificial sequence
  Synthetic oligonucleotide
acagttgcttgacccttaat

SEQ ID NO: 2237 - DNA, 20 bp, Artificial sequence
  Synthetic oligonucleotide
tcaatagtgtaggtgacatg

SEQ ID NO: 2238 - DNA, 20 bp, Artificial sequence
  Synthetic oligonucleotide
atgtgggcctctattaagat

SEQ ID NO: 2239 - DNA, 20 bp, Artificial sequence
  Synthetic oligonucleotide
gacctcaggagattgtacaa

SEQ ID NO: 2240 - DNA, 20 bp, Artificial sequence
  Synthetic oligonucleotide
aagacctataggacctcagg

SEQ ID NO: 2241 - DNA, 20 bp, Artificial sequence
  Synthetic oligonucleotide
gactatcctggtatgactgt

SEQ ID NO: 2242 - DNA, 20 bp, Artificial sequence
  Synthetic oligonucleotide
gattgactacttcaacctga

SEQ ID NO: 2243 - DNA, 20 bp, Artificial sequence
  Synthetic oligonucleotide
tttatagggtggttggttca

SEQ ID NO: 2244 - DNA, 20 bp, Artificial sequence
  Synthetic oligonucleotide
ggatttaccacacatatagg

SEQ ID NO: 2245 - DNA, 20 bp, Artificial sequence
  Synthetic oligonucleotide
ggtaaggcagctcctgacaa

SEQ ID NO: 2246 - DNA, 20 bp, Artificial sequence
  Synthetic oligonucleotide
agaccccacaatttggtccc

SEQ ID NO: 2247 - DNA, 20 bp, Artificial sequence
  Synthetic oligonucleotide
gcacttaggtagttcacaac

SEQ ID NO: 2248 - DNA, 20 bp, Artificial sequence
  Synthetic oligonucleotide
tttattggtcatctcgggta

SEQ ID NO: 2249 - DNA, 20 bp, Artificial sequence
  Synthetic oligonucleotide
cagacttattgaggatggtg

SEQ ID NO: 2250 - DNA, 20 bp, Artificial sequence
  Synthetic oligonucleotide
ttaggacaagtcttatagag

SEQ ID NO: 2251 - DNA, 20 bp, Artificial sequence
  Synthetic oligonucleotide
ctggtaggatctatggcagt

SEQ ID NO: 2252 - DNA, 20 bp, Artificial sequence
  Synthetic oligonucleotide
acagagtagtctattggtgt

SEQ ID NO: 2253 - DNA, 20 bp, Artificial sequence
  Synthetic oligonucleotide
tctccctcttagtgattggt

SEQ ID NO: 2254 - DNA, 20 bp, Artificial sequence
  Synthetic oligonucleotide
ggcctgactaggcattgaat

SEQ ID NO: 2255 - DNA, 20 bp, Artificial sequence
  Synthetic oligonucleotide
tcatgtgcatacccagggta

SEQ ID NO: 2256 - DNA, 20 bp, Artificial sequence
  Synthetic oligonucleotide
taggaccagttggttcactg

SEQ ID NO: 2257 - DNA, 20 bp, Artificial sequence
  Synthetic oligonucleotide
atgttaatagactgcgatta

SEQ ID NO: 2258 - DNA, 20 bp, Artificial sequence
  Synthetic oligonucleotide
gctccctaagcttagatata

SEQ ID NO: 2259 - DNA, 20 bp, Artificial sequence
  Synthetic oligonucleotide
atggaccacctaagacctca

SEQ ID NO: 2260 - DNA, 20 bp, Artificial sequence
  Synthetic oligonucleotide
aatctatgctgggccccaat

SEQ ID NO: 2261 - DNA, 20 bp, Artificial sequence
  Synthetic oligonucleotide
gattaggcctaatctatgct

SEQ ID NO: 2262 - DNA, 20 bp, Artificial sequence
  Synthetic oligonucleotide
tccatctactattaatgagc

SEQ ID NO: 2263 - DNA, 20 bp, Artificial sequence
  Synthetic oligonucleotide
gattaggcagcttcactact

SEQ ID NO: 2264 - DNA, 20 bp, Artificial sequence
  Synthetic oligonucleotide
gtagccccaatacagattca

SEQ ID NO: 2265 - DNA, 20 bp, Artificial sequence
  Synthetic oligonucleotide
acctaactggcctttgggtc

SEQ ID NO: 2266 - DNA, 20 bp, Artificial sequence
  Synthetic oligonucleotide
tcaaggtgttttgacctaac

SEQ ID NO: 2267 - DNA, 20 bp, Artificial sequence
  Synthetic oligonucleotide
gatgggctaagagtcacctg

SEQ ID NO: 2268 - DNA, 20 bp, Artificial sequence
  Synthetic oligonucleotide
tacaaggtattaaggccctt

SEQ ID NO: 2269 - DNA, 20 bp, Artificial sequence
  Synthetic oligonucleotide
ctctttgtaggcccaaggga

SEQ ID NO: 2270 - DNA, 20 bp, Artificial sequence
  Synthetic oligonucleotide
aataggcacttcgggcaaat

SEQ ID NO: 2271 - DNA, 20 bp, Artificial sequence
  Synthetic oligonucleotide
agtgttagcccaggtgatca

SEQ ID NO: 2272 - DNA, 20 bp, Artificial sequence
  Synthetic oligonucleotide
cataggagtgttagcccagg

SEQ ID NO: 2273 - DNA, 20 bp, Artificial sequence
  Synthetic oligonucleotide
tgatgacacccctaccatgg

SEQ ID NO: 2274 - DNA, 20 bp, Artificial sequence
  Synthetic oligonucleotide
attaaggtgatgacacccct

SEQ ID NO: 2275 - DNA, 20 bp, Artificial sequence
  Synthetic oligonucleotide
attagtctaaggcagtcagg

SEQ ID NO: 2276 - DNA, 20 bp, Artificial sequence
  Synthetic oligonucleotide
gtaggtatattagtctaagg

SEQ ID NO: 2277 - DNA, 20 bp, Artificial sequence
  Synthetic oligonucleotide
gtaccgagctcaagaactgt

SEQ ID NO: 2278 - DNA, 20 bp, Artificial sequence
  Synthetic oligonucleotide
tctctgtgtaccgagctcaa

SEQ ID NO: 2279 - DNA, 20 bp, Artificial sequence
  Synthetic oligonucleotide
actctcgctgaggacacatc

SEQ ID NO: 2280 - DNA, 20 bp, Artificial sequence
  Synthetic oligonucleotide
aatgaggacactctcgctga

SEQ ID NO: 2281 - DNA, 20 bp, Artificial sequence
  Synthetic oligonucleotide
ttgggccgcctctgttattg

SEQ ID NO: 2282 - DNA, 20 bp, Artificial sequence
  Synthetic oligonucleotide
gtagaaattgggccgcctct

SEQ ID NO: 2283 - DNA, 20 bp, Artificial sequence
  Synthetic oligonucleotide
taggttgacaggacatgctg

SEQ ID NO: 2284 - DNA, 20 bp, Artificial sequence
  Synthetic oligonucleotide
gcttagtgaactgtgggcac

SEQ ID NO: 2285 - DNA, 20 bp, Artificial sequence
  Synthetic oligonucleotide
acctgtgagggtgcttagtg

SEQ ID NO: 2286 - DNA, 20 bp, Artificial sequence
  Synthetic oligonucleotide
ctaccagggtggtattataa

SEQ ID NO: 2287 - DNA, 20 bp, Artificial sequence
  Synthetic oligonucleotide
caggatagccattcgatacc

SEQ ID NO: 2288 - DNA, 20 bp, Artificial sequence
  Synthetic oligonucleotide
tgccaccgtgattgcaaagt

SEQ ID NO: 2289 - DNA, 20 bp, Artificial sequence
  Synthetic oligonucleotide
acatagaccatagctgaacc

SEQ ID NO: 2290 - DNA, 20 bp, Artificial sequence
  Synthetic oligonucleotide
ggcatccttaaatcctggtt

SEQ ID NO: 2291 - DNA, 20 bp, Artificial sequence
  Synthetic oligonucleotide
ccagggtagaagactagcat

SEQ ID NO: 2292 - DNA, 20 bp, Artificial sequence
  Synthetic oligonucleotide
gaaccctttggtctaagcaa

SEQ ID NO: 2293 - DNA, 20 bp, Artificial sequence
  Synthetic oligonucleotide
tatagattgggctttagagg

SEQ ID NO: 2294 - DNA, 20 bp, Artificial sequence
  Synthetic oligonucleotide
atgccctgtagtatgtggat

SEQ ID NO: 2295 - DNA, 20 bp, Artificial sequence
  Synthetic oligonucleotide
gtaatgctgttgtacactag

SEQ ID NO: 2296 - DNA, 20 bp, Artificial sequence
  Synthetic oligonucleotide
ttttgcataataggaggtcc

SEQ ID NO: 2297 - DNA, 20 bp, Artificial sequence
  Synthetic oligonucleotide
accaaccttaaatagtagga

SEQ ID NO: 2298 - DNA, 20 bp, Artificial sequence
  Synthetic oligonucleotide
tatactccaggttgtggagg

SEQ ID NO: 2299 - DNA, 20 bp, Artificial sequence
  Synthetic oligonucleotide
cattcgatacctgcttttgt

SEQ ID NO: 2300 - DNA, 20 bp, Artificial sequence
  Synthetic oligonucleotide
cgatccaaacaagcaccctc

SEQ ID NO: 2301 - DNA, 20 bp, Artificial sequence
  Synthetic oligonucleotide
atcgatccaaacaagcaccc

SEQ ID NO: 2302 - DNA, 20 bp, Artificial sequence
  Synthetic oligonucleotide
atcatcgatccaaacaagca

SEQ ID NO: 2303 - DNA, 20 bp, Artificial sequence
  Synthetic oligonucleotide
ccgcacatctggacctcaga

SEQ ID NO: 2304 - DNA, 20 bp, Artificial sequence
  Synthetic oligonucleotide
ggccgcacatctggacctca

SEQ ID NO: 2305 - DNA, 20 bp, Artificial sequence
  Synthetic oligonucleotide
gagggccgcacatctggacc

SEQ ID NO: 2306 - DNA, 20 bp, Artificial sequence
  Synthetic oligonucleotide
tggagggccgcacatctgga

SEQ ID NO: 2307 - DNA, 20 bp, Artificial sequence
  Synthetic oligonucleotide
attggagggccgcacatctg

SEQ ID NO: 2308 - DNA, 20 bp, Artificial sequence
  Synthetic oligonucleotide
ctattggagggccgcacatc

SEQ ID NO: 2309 - DNA, 20 bp, Artificial sequence
  Synthetic oligonucleotide
tcctattggagggccgcaca

SEQ ID NO: 2310 - DNA, 20 bp, Artificial sequence
  Synthetic oligonucleotide
ttgtcctattggagggccgc

SEQ ID NO: 2311 - DNA, 20 bp, Artificial sequence
  Synthetic oligonucleotide
atttgtcctattggagggcc

SEQ ID NO: 2312 - DNA, 20 bp, Artificial sequence
  Synthetic oligonucleotide
tatgttgtcactgagggatc

SEQ ID NO: 2313 - DNA, 20 bp, Artificial sequence
  Synthetic oligonucleotide
gtactatgttgtcactgagg

SEQ ID NO: 2314 - DNA, 20 bp, Artificial sequence
  Synthetic oligonucleotide
gccctcttcgaagagataga

SEQ ID NO: 2315 - DNA, 20 bp, Artificial sequence
  Synthetic oligonucleotide
ctgccctcttcgaagagata

SEQ ID NO: 2316 - DNA, 20 bp, Artificial sequence
  Synthetic oligonucleotide
gtcactaggcacactaaagt

SEQ ID NO: 2317 - DNA, 20 bp, Artificial sequence
  Synthetic oligonucleotide
gggtcactaggcacactaaa

SEQ ID NO: 2318 - DNA, 20 bp, Artificial sequence
  Synthetic oligonucleotide
aagtcttgggtcactaggca

SEQ ID NO: 2319 - DNA, 20 bp, Artificial sequence
  Synthetic oligonucleotide
gcaagtcttgggtcactagg

SEQ ID NO: 2320 - DNA, 20 bp, Artificial sequence
  Synthetic oligonucleotide
atggcttagctactcacccc

SEQ ID NO: 2321 - DNA, 20 bp, Artificial sequence
  Synthetic oligonucleotide
ataatggcttagctactcac

SEQ ID NO: 2322 - DNA, 20 bp, Artificial sequence
  Synthetic oligonucleotide
acgacctaaagacctagcaa

SEQ ID NO: 2323 - DNA, 20 bp, Artificial sequence
  Synthetic oligonucleotide
gatgtacaaaacgacctaaa

SEQ ID NO: 2324 - DNA, 20 bp, Artificial sequence
  Synthetic oligonucleotide
acaagtttcgcaataagatt

SEQ ID NO: 2325 - DNA, 20 bp, Artificial sequence
  Synthetic oligonucleotide
gcaagggtcttagtgccaaa

SEQ ID NO: 2326 - DNA, 20 bp, Artificial sequence
  Synthetic oligonucleotide
gtaggacttactaaatcatc

SEQ ID NO: 2327 - DNA, 20 bp, Artificial sequence
  Synthetic oligonucleotide
gccagtaggacttactaaat

SEQ ID NO: 2328 - DNA, 20 bp, Artificial sequence
  Synthetic oligonucleotide
gtgccagtaggacttactaa

SEQ ID NO: 2329 - DNA, 20 bp, Artificial sequence
  Synthetic oligonucleotide
aggattgcatcacatgtgtc

SEQ ID NO: 2330 - DNA, 20 bp, Artificial sequence
  Synthetic oligonucleotide
agcgcattgagcaaaattcc

SEQ ID NO: 2331 - DNA, 20 bp, Artificial sequence
  Synthetic oligonucleotide
gtagcgcattgagcaaaatt

SEQ ID NO: 2332 - DNA, 20 bp, Artificial sequence
  Synthetic oligonucleotide
ctgtagcgcattgagcaaaa

SEQ ID NO: 2333 - DNA, 20 bp, Artificial sequence
  Synthetic oligonucleotide
aactgtagcgcattgagcaa

SEQ ID NO: 2334 - DNA, 20 bp, Artificial sequence
  Synthetic oligonucleotide
gataactgtagcgcattgag

SEQ ID NO: 2335 - DNA, 20 bp, Artificial sequence
  Synthetic oligonucleotide
cacgataactgtagcgcatt

SEQ ID NO: 2336 - DNA, 20 bp, Artificial sequence
  Synthetic oligonucleotide
accacgataactgtagcgca

SEQ ID NO: 2337 - DNA, 20 bp, Artificial sequence
  Synthetic oligonucleotide
tagaccacgataactgtagc

SEQ ID NO: 2338 - DNA, 20 bp, Artificial sequence
  Synthetic oligonucleotide
tttagaccacgataactgta

SEQ ID NO: 2339 - DNA, 20 bp, Artificial sequence
  Synthetic oligonucleotide
gtatatttagaccacgataa

SEQ ID NO: 2340 - DNA, 20 bp, Artificial sequence
  Synthetic oligonucleotide
tctgtatatttagaccacga

SEQ ID NO: 2341 - DNA, 20 bp, Artificial sequence
  Synthetic oligonucleotide
gcaaggacccttaagtcata

SEQ ID NO: 2342 - DNA, 20 bp, Artificial sequence
  Synthetic oligonucleotide
caattgcaaggacccttaag

SEQ ID NO: 2343 - DNA, 20 bp, Artificial sequence
  Synthetic oligonucleotide
ttatcccaattgcaaggacc

SEQ ID NO: 2344 - DNA, 20 bp, Artificial sequence
  Synthetic oligonucleotide
agtcaggcaccagattgctc

SEQ ID NO: 2345 - DNA, 20 bp, Artificial sequence
  Synthetic oligonucleotide
aacgaagccaaaggtacttg

SEQ ID NO: 2346 - DNA, 20 bp, Artificial sequence
  Synthetic oligonucleotide
cggccctgactgtcattcat

SEQ ID NO: 2347 - DNA, 20 bp, Artificial sequence
  Synthetic oligonucleotide
aacggccctgactgtcattc

SEQ ID NO: 2348 - DNA, 20 bp, Artificial sequence
  Synthetic oligonucleotide
ggaacggccctgactgtcat

SEQ ID NO: 2349 - DNA, 20 bp, Artificial sequence
  Synthetic oligonucleotide
gaaggaacggccctgactgt

SEQ ID NO: 2350 - DNA, 20 bp, Artificial sequence
  Synthetic oligonucleotide
ctgaaggaacggccctgact

SEQ ID NO: 2351 - DNA, 20 bp, Artificial sequence
  Synthetic oligonucleotide
gcctgaaggaacggccctga

SEQ ID NO: 2352 - DNA, 20 bp, Artificial sequence
  Synthetic oligonucleotide
tgtggcctgaaggaacggcc

SEQ ID NO: 2353 - DNA, 20 bp, Artificial sequence
  Synthetic oligonucleotide
tcatgtggcctgaaggaacg

SEQ ID NO: 2354 - DNA, 20 bp, Artificial sequence
  Synthetic oligonucleotide
gataatcatgtggcctgaag

SEQ ID NO: 2355 - DNA, 20 bp, Artificial sequence
  Synthetic oligonucleotide
aacgataatcatgtggcctg

SEQ ID NO: 2356 - DNA, 20 bp, Artificial sequence
  Synthetic oligonucleotide
ataacgataatcatgtggcc

SEQ ID NO: 2357 - DNA, 20 bp, Artificial sequence
  Synthetic oligonucleotide
gtatgctagtcactcattga

SEQ ID NO: 2358 - DNA, 20 bp, Artificial sequence
  Synthetic oligonucleotide
tggcaagtatgctagtcact

SEQ ID NO: 2359 - DNA, 20 bp, Artificial sequence
  Synthetic oligonucleotide
cctggcaagtatgctagtca

SEQ ID NO: 2360 - DNA, 20 bp, Artificial sequence
  Synthetic oligonucleotide
gatcctggcaagtatgctag

SEQ ID NO: 2361 - DNA, 20 bp, Artificial sequence
  Synthetic oligonucleotide
tagatcctggcaagtatgct

SEQ ID NO: 2362 - DNA, 20 bp, Artificial sequence
  Synthetic oligonucleotide
tgtagatcctggcaagtatg

SEQ ID NO: 2363 - DNA, 20 bp, Artificial sequence
  Synthetic oligonucleotide
tcaacattatatcgatgcaa

SEQ ID NO: 2364 - DNA, 20 bp, Artificial sequence
  Synthetic oligonucleotide
cttgtcaacattatatcgat

SEQ ID NO: 2365 - DNA, 20 bp, Artificial sequence
  Synthetic oligonucleotide
aacttgtcaacattatatcg

SEQ ID NO: 2366 - DNA, 20 bp, Artificial sequence
  Synthetic oligonucleotide
gtttcgcaataagattccat

SEQ ID NO: 2367 - DNA, 20 bp, Artificial sequence
  Synthetic oligonucleotide
ttagctactcacccctgttc

SEQ ID NO: 2368 - DNA, 20 bp, Artificial sequence
  Synthetic oligonucleotide
agataatggcttagctactc

SEQ ID NO: 2369 - DNA, 20 bp, Artificial sequence
  Synthetic oligonucleotide
aaaacgacctaaagacctag

SEQ ID NO: 2370 - DNA, 20 bp, Artificial sequence
  Synthetic oligonucleotide
aggattcaatagtgtaggtg

SEQ ID NO: 2371 - DNA, 20 bp, Artificial sequence
  Synthetic oligonucleotide
gcacacctggatttcactac

SEQ ID NO: 2372 - DNA, 20 bp, Artificial sequence
  Synthetic oligonucleotide
ttggcacacctggatttcac

SEQ ID NO: 2373 - DNA, 20 bp, Artificial sequence
  Synthetic oligonucleotide
ataacttaccttgttgcaac

SEQ ID NO: 2374 - DNA, 20 bp, Artificial sequence
  Synthetic oligonucleotide
ttgagaagaaaaccctatcg

SEQ ID NO: 2375 - DNA, 20 bp, Artificial sequence
  Synthetic oligonucleotide
atatttagaccacgataact

SEQ ID NO: 2376 - DNA, 20 bp, Artificial sequence
  Synthetic oligonucleotide
ccctcttgtagatcctggca

SEQ ID NO: 2377 - DNA, 20 bp, Artificial sequence
  Synthetic oligonucleotide
aggtcttatttaccattggc

SEQ ID NO: 2378 - DNA, 20 bp, Artificial sequence
  Synthetic oligonucleotide
taatgatcatactggagcca

SEQ ID NO: 2379 - DNA, 20 bp, Artificial sequence
  Synthetic oligonucleotide
ctcacgctgtgtgaatcaaa

SEQ ID NO: 2380 - DNA, 20 bp, Artificial sequence
  Synthetic oligonucleotide
ggaagtctaggtctcacgct

SEQ ID NO: 2381 - DNA, 20 bp, Artificial sequence
  Synthetic oligonucleotide
ctacataggcactctactag

SEQ ID NO: 2382 - DNA, 20 bp, Artificial sequence
  Synthetic oligonucleotide
acccttatggagacttatat

SEQ ID NO: 2383 - DNA, 20 bp, Artificial sequence
  Synthetic oligonucleotide
gactccacacacctactaga

SEQ ID NO: 2384 - DNA, 20 bp, Artificial sequence
  Synthetic oligonucleotide
caagcaaagactacaccgtg

SEQ ID NO: 2385 - DNA, 20 bp, Artificial sequence
  Synthetic oligonucleotide
tatccagggtagaagactag

SEQ ID NO: 2386 - DNA, 20 bp, Artificial sequence
  Synthetic oligonucleotide
ggtgtatattccctatccag

SEQ ID NO: 2387 - DNA, 20 bp, Artificial sequence
  Synthetic oligonucleotide
agtgggatggctgtcaatgc

SEQ ID NO: 2388 - DNA, 20 bp, Artificial sequence
  Synthetic oligonucleotide
agggatccccaaatagagcc

SEQ ID NO: 2389 - DNA, 20 bp, Artificial sequence
  Synthetic oligonucleotide
tcacagttgcttgaccctta

SEQ ID NO: 2390 - DNA, 20 bp, Artificial sequence
  Synthetic oligonucleotide
tatgaaccatggagtctcta

SEQ ID NO: 2391 - DNA, 20 bp, Artificial sequence
  Synthetic oligonucleotide
tccctaatatagggcagatg

SEQ ID NO: 2392 - DNA, 20 bp, Artificial sequence
  Synthetic oligonucleotide
tataggacctcaggagattg

SEQ ID NO: 2393 - DNA, 20 bp, Artificial sequence
  Synthetic oligonucleotide
tcaagacctataggacctca

SEQ ID NO: 2394 - DNA, 20 bp, Artificial sequence
  Synthetic oligonucleotide
aaagactatcctggtatgac

SEQ ID NO: 2395 - DNA, 20 bp, Artificial sequence
  Synthetic oligonucleotide
gatttgagcctgctatgtct

SEQ ID NO: 2396 - DNA, 20 bp, Artificial sequence
  Synthetic oligonucleotide
acattcagctagactagttg

SEQ ID NO: 2397 - DNA, 20 bp, Artificial sequence
  Synthetic oligonucleotide
tgagaccccacaatttggtc

SEQ ID NO: 2398 - DNA, 20 bp, Artificial sequence
  Synthetic oligonucleotide
taggtagttcacaactcttc

SEQ ID NO: 2399 - DNA, 20 bp, Artificial sequence
  Synthetic oligonucleotide
atatgccctgtagtatgtgg

SEQ ID NO: 2400 - DNA, 20 bp, Artificial sequence
  Synthetic oligonucleotide
attttattggtcatctcggg

SEQ ID NO: 2401 - DNA, 20 bp, Artificial sequence
  Synthetic oligonucleotide
tgtcagacttattgaggatg

SEQ ID NO: 2402 - DNA, 20 bp, Artificial sequence
  Synthetic oligonucleotide
actcccacaaggtactcttg

SEQ ID NO: 2403 - DNA, 20 bp, Artificial sequence
  Synthetic oligonucleotide
aactggtaggatctatggca

SEQ ID NO: 2404 - DNA, 20 bp, Artificial sequence
  Synthetic oligonucleotide
ttcacagagtagtctattgg

SEQ ID NO: 2405 - DNA, 20 bp, Artificial sequence
  Synthetic oligonucleotide
tgtagtatgcattgacaagc

SEQ ID NO: 2406 - DNA, 20 bp, Artificial sequence
  Synthetic oligonucleotide
gagttacaagtgtcatatac

SEQ ID NO: 2407 - DNA, 20 bp, Artificial sequence
  Synthetic oligonucleotide
ggtaggattcatggtccaaa

SEQ ID NO: 2408 - DNA, 20 bp, Artificial sequence
  Synthetic oligonucleotide
cctaggaccagttggttcac

SEQ ID NO: 2409 - DNA, 20 bp, Artificial sequence
  Synthetic oligonucleotide
actgggttgagactattcag

SEQ ID NO: 2410 - DNA, 20 bp, Artificial sequence
  Synthetic oligonucleotide
caatggaccacctaagacct

SEQ ID NO: 2411 - DNA, 20 bp, Artificial sequence
  Synthetic oligonucleotide
ctaatctatgctgggcccca

SEQ ID NO: 2412 - DNA, 20 bp, Artificial sequence
  Synthetic oligonucleotide
gagattaggcctaatctatg

SEQ ID NO: 2413 - DNA, 20 bp, Artificial sequence
  Synthetic oligonucleotide
attaggtatggaggccatgt

SEQ ID NO: 2414 - DNA, 20 bp, Artificial sequence
  Synthetic oligonucleotide
aaggtagccccaatacagat

SEQ ID NO: 2415 - DNA, 20 bp, Artificial sequence
  Synthetic oligonucleotide
gaggtactgtaagccctttg

SEQ ID NO: 2416 - DNA, 20 bp, Artificial sequence
  Synthetic oligonucleotide
gttttgacctaactggcctt

SEQ ID NO: 2417 - DNA, 20 bp, Artificial sequence
  Synthetic oligonucleotide
ctaaggagtgctctttgtgg

SEQ ID NO: 2418 - DNA, 20 bp, Artificial sequence
  Synthetic oligonucleotide
aggtattaaggcccttggcc

SEQ ID NO: 2419 - DNA, 20 bp, Artificial sequence
  Synthetic oligonucleotide
gtatacaaggtattaaggcc

SEQ ID NO: 2420 - DNA, 20 bp, Artificial sequence
  Synthetic oligonucleotide
taggcagctctttgtaggcc

SEQ ID NO: 2421 - DNA, 20 bp, Artificial sequence
  Synthetic oligonucleotide
agttctgtatacaccatccc

SEQ ID NO: 2422 - DNA, 20 bp, Artificial sequence
  Synthetic oligonucleotide
ggagtgttagcccaggtgat

SEQ ID NO: 2423 - DNA, 20 bp, Artificial sequence
  Synthetic oligonucleotide
gtcataggagtgttagccca

SEQ ID NO: 2424 - DNA, 20 bp, Artificial sequence
  Synthetic oligonucleotide
ggtgatgacacccctaccat

SEQ ID NO: 2425 - DNA, 20 bp, Artificial sequence
  Synthetic oligonucleotide
gccttggttgtggtgaaacc

SEQ ID NO: 2426 - DNA, 20 bp, Artificial sequence
  Synthetic oligonucleotide
gtgaactcctgtgactgata

SEQ ID NO: 2427 - DNA, 20 bp, Artificial sequence
  Synthetic oligonucleotide
tatattagtctaaggcagtc

SEQ ID NO: 2428 - DNA, 20 bp, Artificial sequence
  Synthetic oligonucleotide
gtgtaccgagctcaagaact

SEQ ID NO: 2429 - DNA, 20 bp, Artificial sequence
  Synthetic oligonucleotide
ctgtctctgtgtaccgagct

SEQ ID NO: 2430 - DNA, 20 bp, Artificial sequence
  Synthetic oligonucleotide
ccgcctctgttattgtgata

SEQ ID NO: 2431 - DNA, 20 bp, Artificial sequence
  Synthetic oligonucleotide
aattgggccgcctctgttat

SEQ ID NO: 2432 - DNA, 20 bp, Artificial sequence
  Synthetic oligonucleotide
agtcaggtacaggtgttgga

SEQ ID NO: 2433 - DNA, 20 bp, Artificial sequence
  Synthetic oligonucleotide
tgtaggttgacaggacatgc

SEQ ID NO: 2434 - DNA, 20 bp, Artificial sequence
  Synthetic oligonucleotide
gagggtgcttagtgaactgt

SEQ ID NO: 2435 - DNA, 20 bp, Artificial sequence
  Synthetic oligonucleotide
aagacctgtgagggtgctta

SEQ ID NO: 2436 - DNA, 20 bp, Artificial sequence
  Synthetic oligonucleotide
agtctgtctttagggtcacc

SEQ ID NO: 2437 - DNA, 20 bp, Artificial sequence
  Synthetic oligonucleotide
tagccattcgatacctgctt

SEQ ID NO: 2438 - DNA, 20 bp, Artificial sequence
  Synthetic oligonucleotide
tgcaggatagccattcgata

SEQ ID NO: 2439 - DNA, 20 bp, Artificial sequence
  Synthetic oligonucleotide
atgaatgccaccgtgattgc

SEQ ID NO: 2440 - DNA, 20 bp, Artificial sequence
  Synthetic oligonucleotide
agttgtgtctgagggatatc

SEQ ID NO: 2441 - DNA, 20 bp, Artificial sequence
  Synthetic oligonucleotide
agggtcttagtgccaaatat

SEQ ID NO: 2442 - DNA, 20 bp, Artificial sequence
  Synthetic oligonucleotide
taccaaagtggctgctcacc

SEQ ID NO: 2443 - DNA, 20 bp, Artificial sequence
  Synthetic oligonucleotide
tagccctttcagcacacttc

SEQ ID NO: 2444 - DNA, 20 bp, Artificial sequence
  Synthetic oligonucleotide
ctggcaatatgtcaacctta

SEQ ID NO: 2445 - DNA, 20 bp, Artificial sequence
  Synthetic oligonucleotide
agtgcacagataatgactag

SEQ ID NO: 2446 - DNA, 20 bp, Artificial sequence
  Synthetic oligonucleotide
gacttgtcttatggctgcct

SEQ ID NO: 2447 - DNA, 20 bp, Artificial sequence
  Synthetic oligonucleotide
cctaatagcaccagaatagt

SEQ ID NO: 2448 - DNA, 20 bp, Artificial sequence
  Synthetic oligonucleotide
cccaatacagattcagtggc

SEQ ID NO: 2449 - DNA, 20 bp, Artificial sequence
  Synthetic oligonucleotide
tgaagtagtcctgccctttc

SEQ ID NO: 2450 - DNA, 20 bp, Artificial sequence
  Synthetic oligonucleotide
acactctcgctgaggacaca

SEQ ID NO: 2451 - DNA, 20 bp, Artificial sequence
  Synthetic oligonucleotide
gggcattcagtgctccctcc

SEQ ID NO: 2452 - DNA, 20 bp, Artificial sequence
  Synthetic oligonucleotide
caagggtcttagtgccaaat

SEQ ID NO: 2453 - DNA, 20 bp, Artificial sequence
  Synthetic oligonucleotide
tatgctagtcactcattgag

SEQ ID NO: 2454 - DNA, 20 bp, Artificial sequence
  Synthetic oligonucleotide
taggtctcacgctgtgtgaa

SEQ ID NO: 2455 - DNA, 20 bp, Artificial sequence
  Synthetic oligonucleotide
gagggaagtctaggtctcac

SEQ ID NO: 2456 - DNA, 20 bp, Artificial sequence
  Synthetic oligonucleotide
taactacataggcactctac

SEQ ID NO: 2457 - DNA, 20 bp, Artificial sequence
  Synthetic oligonucleotide
agatttgacccttatggaga

SEQ ID NO: 2458 - DNA, 20 bp, Artificial sequence
  Synthetic oligonucleotide
agtggactccacacacctac

SEQ ID NO: 2459 - DNA, 20 bp, Artificial sequence
  Synthetic oligonucleotide
tatattccctatccagggta

SEQ ID NO: 2460 - DNA, 20 bp, Artificial sequence
  Synthetic oligonucleotide
gacaggtgtatattccctat

SEQ ID NO: 2461 - DNA, 20 bp, Artificial sequence
  Synthetic oligonucleotide
tgtgcatggttatctaatgc

SEQ ID NO: 2462 - DNA, 20 bp, Artificial sequence
  Synthetic oligonucleotide
gttgcttgacccttaattca

SEQ ID NO: 2463 - DNA, 20 bp, Artificial sequence
  Synthetic oligonucleotide
catatcacagttgcttgacc

SEQ ID NO: 2464 - DNA, 20 bp, Artificial sequence
  Synthetic oligonucleotide
ttgatctattatgagggcat

SEQ ID NO: 2465 - DNA, 20 bp, Artificial sequence
  Synthetic oligonucleotide
cctcaggagattgtacaaca

SEQ ID NO: 2466 - DNA, 20 bp, Artificial sequence
  Synthetic oligonucleotide
ctatcctggtatgactgtca

SEQ ID NO: 2467 - DNA, 20 bp, Artificial sequence
  Synthetic oligonucleotide
atagtgtggatggtatcctg

SEQ ID NO: 2468 - DNA, 20 bp, Artificial sequence
  Synthetic oligonucleotide
tatagggtggttggttcaaa

SEQ ID NO: 2469 - DNA, 20 bp, Artificial sequence
  Synthetic oligonucleotide
accacacatataggctagcc

SEQ ID NO: 2470 - DNA, 20 bp, Artificial sequence
  Synthetic oligonucleotide
gaacattcagctagactagt

SEQ ID NO: 2471 - DNA, 20 bp, Artificial sequence
  Synthetic oligonucleotide
acttaggtagttcacaactc

SEQ ID NO: 2472 - DNA, 20 bp, Artificial sequence
  Synthetic oligonucleotide
ccctgtagtatgtggatact

SEQ ID NO: 2473 - DNA, 20 bp, Artificial sequence
  Synthetic oligonucleotide
ttggtcatctcgggtatata

SEQ ID NO: 2474 - DNA, 20 bp, Artificial sequence
  Synthetic oligonucleotide
cttattgaggatggtgtgta

SEQ ID NO: 2475 - DNA, 20 bp, Artificial sequence
  Synthetic oligonucleotide
tccctcttagtgattggtgg

SEQ ID NO: 2476 - DNA, 20 bp, Artificial sequence
  Synthetic oligonucleotide
ctaggcattgaatgagggcc

SEQ ID NO: 2477 - DNA, 20 bp, Artificial sequence
  Synthetic oligonucleotide
agggtaggattcatggtcca

SEQ ID NO: 2478 - DNA, 20 bp, Artificial sequence
  Synthetic oligonucleotide
ttaatagactgcgattatac

SEQ ID NO: 2479 - DNA, 20 bp, Artificial sequence
  Synthetic oligonucleotide
tccctaagcttagatatacc

SEQ ID NO: 2480 - DNA, 20 bp, Artificial sequence
  Synthetic oligonucleotide
gaccacctaagacctcaagg

SEQ ID NO: 2481 - DNA, 20 bp, Artificial sequence
  Synthetic oligonucleotide
ttaggcctaatctatgctgg

SEQ ID NO: 2482 - DNA, 20 bp, Artificial sequence
  Synthetic oligonucleotide
atgagattaggcctaatcta

SEQ ID NO: 2483 - DNA, 20 bp, Artificial sequence
  Synthetic oligonucleotide
agattaggtatggaggccat

SEQ ID NO: 2484 - DNA, 20 bp, Artificial sequence
  Synthetic oligonucleotide
gccccaatacagattcagtg

SEQ ID NO: 2485 - DNA, 20 bp, Artificial sequence
  Synthetic oligonucleotide
ggtgttttgacctaactggc

SEQ ID NO: 2486 - DNA, 20 bp, Artificial sequence
  Synthetic oligonucleotide
ggctaagagtcacctgtatc

SEQ ID NO: 2487 - DNA, 20 bp, Artificial sequence
  Synthetic oligonucleotide
caaggtattaaggcccttgg

SEQ ID NO: 2488 - DNA, 20 bp, Artificial sequence
  Synthetic oligonucleotide
ttgtaggcccaagggaattg

SEQ ID NO: 2489 - DNA, 20 bp, Artificial sequence
  Synthetic oligonucleotide
gctaggcagctctttgtagg

SEQ ID NO: 2490 - DNA, 20 bp, Artificial sequence
  Synthetic oligonucleotide
tgttagcccaggtgatcagc

SEQ ID NO: 2491 - DNA, 20 bp, Artificial sequence
  Synthetic oligonucleotide
taggagtgttagcccaggtg

SEQ ID NO: 2492 - DNA, 20 bp, Artificial sequence
  Synthetic oligonucleotide
agggtcataggagtgttagc

SEQ ID NO: 2493 - DNA, 20 bp, Artificial sequence
  Synthetic oligonucleotide
taaggtgatgacacccctac

SEQ ID NO: 2494 - DNA, 20 bp, Artificial sequence
  Synthetic oligonucleotide
gggtcagttgtgcagttgtt

SEQ ID NO: 2495 - DNA, 20 bp, Artificial sequence
  Synthetic oligonucleotide
aggtatattagtctaaggca

SEQ ID NO: 2496 - DNA, 20 bp, Artificial sequence
  Synthetic oligonucleotide
ctattatcttcttagggtcg

SEQ ID NO: 2497 - DNA, 20 bp, Artificial sequence
  Synthetic oligonucleotide
ctgtgtaccgagctcaagaa

SEQ ID NO: 2498 - DNA, 20 bp, Artificial sequence
  Synthetic oligonucleotide
catcagctgttagcagtctg

SEQ ID NO: 2499 - DNA, 20 bp, Artificial sequence
  Synthetic oligonucleotide
aggacactctcgctgaggac

SEQ ID NO: 2500 - DNA, 20 bp, Artificial sequence
  Synthetic oligonucleotide
ggccgcctctgttattgtga

SEQ ID NO: 2501 - DNA, 20 bp, Artificial sequence
  Synthetic oligonucleotide
gaaattgggccgcctctgtt

SEQ ID NO: 2502 - DNA, 20 bp, Artificial sequence
  Synthetic oligonucleotide
ctagcttccacctaagagct

SEQ ID NO: 2503 - DNA, 20 bp, Artificial sequence
  Synthetic oligonucleotide
aactctgtaggttgacagga

SEQ ID NO: 2504 - DNA, 20 bp, Artificial sequence
  Synthetic oligonucleotide
tgtgagggtgcttagtgaac

SEQ ID NO: 2505 - DNA, 20 bp, Artificial sequence
  Synthetic oligonucleotide
ctgtcaaagacctgtgaggg

SEQ ID NO: 2506 - DNA, 20 bp, Artificial sequence
  Synthetic oligonucleotide
ggatagccattcgatacctg

SEQ ID NO: 2507 - DNA, 20 bp, Artificial sequence
  Synthetic oligonucleotide
ttattcttaccgtctttagg

SEQ ID NO: 2508 - DNA, 20 bp, Artificial sequence
  Synthetic oligonucleotide
agctcatcacaactgggtgg

SEQ ID NO: 2509 - DNA, 20 bp, Artificial sequence
  Synthetic oligonucleotide
agagatatgattagtactgg

SEQ ID NO: 2510 - DNA, 20 bp, Artificial sequence
  Synthetic oligonucleotide
gtgatattgcagtgggatgg

SEQ ID NO: 2511 - DNA, 20 bp, Artificial sequence
  Synthetic oligonucleotide
acctataggacctcaggaga

SEQ ID NO: 2512 - DNA, 20 bp, Artificial sequence
  Synthetic oligonucleotide
actgggttactttccaatag

SEQ ID NO: 2513 - DNA, 20 bp, Artificial sequence
  Synthetic oligonucleotide
caatttacttgatacagggc

SEQ ID NO: 2514 - DNA, 20 bp, Artificial sequence
  Synthetic oligonucleotide
gtcaattgtcagacttattg

SEQ ID NO: 2515 - DNA, 20 bp, Artificial sequence
  Synthetic oligonucleotide
gggcctgtatgtcttgagaa

SEQ ID NO: 2516 - DNA, 20 bp, Artificial sequence
  Synthetic oligonucleotide
agtagtctattggtgttcct

SEQ ID NO: 2517 - DNA, 20 bp, Artificial sequence
  Synthetic oligonucleotide
atactgtagtatgcattgac

SEQ ID NO: 2518 - DNA, 20 bp, Artificial sequence
  Synthetic oligonucleotide
ttactagggccagagaatcc

SEQ ID NO: 2519 - DNA, 20 bp, Artificial sequence
  Synthetic oligonucleotide
cagatgactagcctccaaac

SEQ ID NO: 2520 - DNA, 20 bp, Artificial sequence
  Synthetic oligonucleotide
gcataataggaggtccttaa

SEQ ID NO: 2521 - DNA, 20 bp, Artificial sequence
  Synthetic oligonucleotide
gtcaaatcaatttgtgccac

SEQ ID NO: 2522 - DNA, 20 bp, Artificial sequence
  Synthetic oligonucleotide
ctaaggcagtcagggtaatg

SEQ ID NO: 2523 - DNA, 20 bp, Artificial sequence
  Synthetic oligonucleotide
ttaagaagcttgcctttcga

SEQ ID NO: 2524 - DNA, 20 bp, Artificial sequence
  Synthetic oligonucleotide
ttcgatacctgcttttgtga

SEQ ID NO: 2525 - DNA, 20 bp, Artificial sequence
  Synthetic oligonucleotide
ctgatgatttgttgattacc

SEQ ID NO: 2526 - DNA, 20 bp, Artificial sequence
  Synthetic oligonucleotide
atagtgccagtaggacttac

SEQ ID NO: 2527 - DNA, 20 bp, Artificial sequence
  Synthetic oligonucleotide
agtatgctagtcactcattg

SEQ ID NO: 2528 - DNA, 20 bp, Artificial sequence
  Synthetic oligonucleotide
ctaggtctcacgctgtgtga

SEQ ID NO: 2529 - DNA, 20 bp, Artificial sequence
  Synthetic oligonucleotide
tatgagggaagtctaggtct

SEQ ID NO: 2530 - DNA, 20 bp, Artificial sequence
  Synthetic oligonucleotide
aagatttgacccttatggag

SEQ ID NO: 2531 - DNA, 20 bp, Artificial sequence
  Synthetic oligonucleotide
gagtggactccacacaccta

SEQ ID NO: 2532 - DNA, 20 bp, Artificial sequence
  Synthetic oligonucleotide
gtatattccctatccagggt

SEQ ID NO: 2533 - DNA, 20 bp, Artificial sequence
  Synthetic oligonucleotide
tgacaggtgtatattcccta

SEQ ID NO: 2534 - DNA, 20 bp, Artificial sequence
  Synthetic oligonucleotide
agtgatattgcagtgggatg

SEQ ID NO: 2535 - DNA, 20 bp, Artificial sequence
  Synthetic oligonucleotide
catcatcgatccaaacaagc

SEQ ID NO: 2536 - DNA, 20 bp, Artificial sequence
  Synthetic oligonucleotide
cagttgcttgacccttaatt

SEQ ID NO: 2537 - DNA, 20 bp, Artificial sequence
  Synthetic oligonucleotide
acatggtgagggtctcaatg

SEQ ID NO: 2538 - DNA, 20 bp, Artificial sequence
  Synthetic oligonucleotide
acttgatctattatgagggc

SEQ ID NO: 2539 - DNA, 20 bp, Artificial sequence
  Synthetic oligonucleotide
acctcaggagattgtacaac

SEQ ID NO: 2540 - DNA, 20 bp, Artificial sequence
  Synthetic oligonucleotide
agacctataggacctcagga

SEQ ID NO: 2541 - DNA, 20 bp, Artificial sequence
  Synthetic oligonucleotide
actatcctggtatgactgtc

SEQ ID NO: 2542 - DNA, 20 bp, Artificial sequence
  Synthetic oligonucleotide
ttatagtgtggatggtatcc

SEQ ID NO: 2543 - DNA, 20 bp, Artificial sequence
  Synthetic oligonucleotide
ttatagggtggttggttcaa

SEQ ID NO: 2544 - DNA, 20 bp, Artificial sequence
  Synthetic oligonucleotide
taccacacatataggctagc

SEQ ID NO: 2545 - DNA, 20 bp, Artificial sequence
  Synthetic oligonucleotide
cctaaggtgaagtctgtgta

SEQ ID NO: 2546 - DNA, 20 bp, Artificial sequence
  Synthetic oligonucleotide
cacttaggtagttcacaact

SEQ ID NO: 2547 - DNA, 20 bp, Artificial sequence
  Synthetic oligonucleotide
tgccctgtagtatgtggata

SEQ ID NO: 2548 - DNA, 20 bp, Artificial sequence
  Synthetic oligonucleotide
tattggtcatctcgggtata

SEQ ID NO: 2549 - DNA, 20 bp, Artificial sequence
  Synthetic oligonucleotide
tggtaggatctatggcagtt

SEQ ID NO: 2550 - DNA, 20 bp, Artificial sequence
  Synthetic oligonucleotide
cagagtagtctattggtgtt

SEQ ID NO: 2551 - DNA, 20 bp, Artificial sequence
  Synthetic oligonucleotide
ctccctcttagtgattggtg

SEQ ID NO: 2552 - DNA, 20 bp, Artificial sequence
  Synthetic oligonucleotide
cctacccttgcatgctatgt

SEQ ID NO: 2553 - DNA, 20 bp, Artificial sequence
  Synthetic oligonucleotide
gcctgactaggcattgaatg

SEQ ID NO: 2554 - DNA, 20 bp, Artificial sequence
  Synthetic oligonucleotide
gttactagggccagagaatc

SEQ ID NO: 2555 - DNA, 20 bp, Artificial sequence
  Synthetic oligonucleotide
gttaatagactgcgattata

SEQ ID NO: 2556 - DNA, 20 bp, Artificial sequence
  Synthetic oligonucleotide
ctccctaagcttagatatac

SEQ ID NO: 2557 - DNA, 20 bp, Artificial sequence
  Synthetic oligonucleotide
attaggcctaatctatgctg

SEQ ID NO: 2558 - DNA, 20 bp, Artificial sequence
  Synthetic oligonucleotide
agatgagattaggcctaatc

SEQ ID NO: 2559 - DNA, 20 bp, Artificial sequence
  Synthetic oligonucleotide
acagattaggtatggaggcc

SEQ ID NO: 2560 - DNA, 20 bp, Artificial sequence
  Synthetic oligonucleotide
tagccccaatacagattcag

SEQ ID NO: 2561 - DNA, 20 bp, Artificial sequence
  Synthetic oligonucleotide
tgcataataggaggtcctta

SEQ ID NO: 2562 - DNA, 20 bp, Artificial sequence
  Synthetic oligonucleotide
tacttttggtaggtaactac

SEQ ID NO: 2563 - DNA, 20 bp, Artificial sequence
  Synthetic oligonucleotide
aggtgttttgacctaactgg

SEQ ID NO: 2564 - DNA, 20 bp, Artificial sequence
  Synthetic oligonucleotide
tgggctaagagtcacctgta

SEQ ID NO: 2565 - DNA, 20 bp, Artificial sequence
  Synthetic oligonucleotide
acaaggtattaaggcccttg

SEQ ID NO: 2566 - DNA, 20 bp, Artificial sequence
  Synthetic oligonucleotide
tttgtaggcccaagggaatt

SEQ ID NO: 2567 - DNA, 20 bp, Artificial sequence
  Synthetic oligonucleotide
gcccgatgacaccagccact

SEQ ID NO: 2568 - DNA, 20 bp, Artificial sequence
  Synthetic oligonucleotide
gtgttagcccaggtgatcag

SEQ ID NO: 2569 - DNA, 20 bp, Artificial sequence
  Synthetic oligonucleotide
ataggagtgttagcccaggt

SEQ ID NO: 2570 - DNA, 20 bp, Artificial sequence
  Synthetic oligonucleotide
gatgacacccctaccatggc

SEQ ID NO: 2571 - DNA, 20 bp, Artificial sequence
  Synthetic oligonucleotide
ttaaggtgatgacaccccta

SEQ ID NO: 2572 - DNA, 20 bp, Artificial sequence
  Synthetic oligonucleotide
aagggtcagttgtgcagttg

SEQ ID NO: 2573 - DNA, 20 bp, Artificial sequence
  Synthetic oligonucleotide
ttagtctaaggcagtcaggg

SEQ ID NO: 2574 - DNA, 20 bp, Artificial sequence
  Synthetic oligonucleotide
taggtatattagtctaaggc

SEQ ID NO: 2575 - DNA, 20 bp, Artificial sequence
  Synthetic oligonucleotide
cgagctcaagaactgtgact

SEQ ID NO: 2576 - DNA, 20 bp, Artificial sequence
  Synthetic oligonucleotide
tctgtgtaccgagctcaaga

SEQ ID NO: 2577 - DNA, 20 bp, Artificial sequence
  Synthetic oligonucleotide
acatcagctgttagcagtct

SEQ ID NO: 2578 - DNA, 20 bp, Artificial sequence
  Synthetic oligonucleotide
gaggacactctcgctgagga

SEQ ID NO: 2579 - DNA, 20 bp, Artificial sequence
  Synthetic oligonucleotide
tgggccgcctctgttattgt

SEQ ID NO: 2580 - DNA, 20 bp, Artificial sequence
  Synthetic oligonucleotide
tagaaattgggccgcctctg

SEQ ID NO: 2581 - DNA, 20 bp, Artificial sequence
  Synthetic oligonucleotide
cctagcttccacctaagagc

SEQ ID NO: 2582 - DNA, 20 bp, Artificial sequence
  Synthetic oligonucleotide
gaactctgtaggttgacagg

SEQ ID NO: 2583 - DNA, 20 bp, Artificial sequence
  Synthetic oligonucleotide
cctgtgagggtgcttagtga

SEQ ID NO: 2584 - DNA, 20 bp, Artificial sequence
  Synthetic oligonucleotide
acctttggagctttgactgg

SEQ ID NO: 2585 - DNA, 20 bp, Artificial sequence
  Synthetic oligonucleotide
attcgatacctgcttttgtg

SEQ ID NO: 2586 - DNA, 20 bp, Artificial sequence
  Synthetic oligonucleotide
aggatagccattcgatacct

SEQ ID NO: 2587 - DNA, 20 bp, Artificial sequence
  Synthetic oligonucleotide
aagtgaactacttggagacc

SEQ ID NO: 2588 - DNA, 20 bp, Artificial sequence
  Synthetic oligonucleotide
tgtatggcttatgcatgcta

SEQ ID NO: 2589 - DNA, 20 bp, Artificial sequence
  Synthetic oligonucleotide
tattaactacataggcactc

SEQ ID NO: 2590 - DNA, 20 bp, Artificial sequence
  Synthetic oligonucleotide
cagggtagaagactagcata

SEQ ID NO: 2591 - DNA, 20 bp, Artificial sequence
  Synthetic oligonucleotide
ttagcacttctataactggg

SEQ ID NO: 2592 - DNA, 20 bp, Artificial sequence
  Synthetic oligonucleotide
atagattgggctttagaggt

SEQ ID NO: 2593 - DNA, 20 bp, Artificial sequence
  Synthetic oligonucleotide
agacttattgaggatggtgt

SEQ ID NO: 2594 - DNA, 20 bp, Artificial sequence
  Synthetic oligonucleotide
taggacaagtcttatagaga

SEQ ID NO: 2595 - DNA, 20 bp, Artificial sequence
  Synthetic oligonucleotide
atgtgcatacccagggtagg

SEQ ID NO: 2596 - DNA, 20 bp, Artificial sequence
  Synthetic oligonucleotide
tctatgctgggccccaattc

SEQ ID NO: 2597 - DNA, 20 bp, Artificial sequence
  Synthetic oligonucleotide
aggttgtggaggttgttcct

SEQ ID NO: 2598 - DNA, 20 bp, Artificial sequence
  Synthetic oligonucleotide
acctgcagttatttagccat

SEQ ID NO: 2599 - DNA, 20 bp, Artificial sequence
  Synthetic oligonucleotide
aacctccaagtgcttcaagc

SEQ ID NO: 2600 - DNA, 20 bp, Artificial sequence
  Synthetic oligonucleotide
cttatttgtcctattggagg

SEQ ID NO: 2601 - DNA, 20 bp, Artificial sequence
  Synthetic oligonucleotide
tcgatccaaacaagcaccct

SEQ ID NO: 2602 - DNA, 20 bp, Artificial sequence
  Synthetic oligonucleotide
tcatcgatccaaacaagcac

SEQ ID NO: 2603 - DNA, 20 bp, Artificial sequence
  Synthetic oligonucleotide
cgcacatctggacctcagat

SEQ ID NO: 2604 - DNA, 20 bp, Artificial sequence
  Synthetic oligonucleotide
gccgcacatctggacctcag

SEQ ID NO: 2605 - DNA, 20 bp, Artificial sequence
  Synthetic oligonucleotide
agggccgcacatctggacct

SEQ ID NO: 2606 - DNA, 20 bp, Artificial sequence
  Synthetic oligonucleotide
ggagggccgcacatctggac

SEQ ID NO: 2607 - DNA, 20 bp, Artificial sequence
  Synthetic oligonucleotide
ttggagggccgcacatctgg

SEQ ID NO: 2608 - DNA, 20 bp, Artificial sequence
  Synthetic oligonucleotide
tattggagggccgcacatct

SEQ ID NO: 2609 - DNA, 20 bp, Artificial sequence
  Synthetic oligonucleotide
cctattggagggccgcacat

SEQ ID NO: 2610 - DNA, 20 bp, Artificial sequence
  Synthetic oligonucleotide
tgtcctattggagggccgca

SEQ ID NO: 2611 - DNA, 20 bp, Artificial sequence
  Synthetic oligonucleotide
tttgtcctattggagggccg

SEQ ID NO: 2612 - DNA, 20 bp, Artificial sequence
  Synthetic oligonucleotide
tactatgttgtcactgaggg

SEQ ID NO: 2613 - DNA, 20 bp, Artificial sequence
  Synthetic oligonucleotide
ggtactatgttgtcactgag

SEQ ID NO: 2614 - DNA, 20 bp, Artificial sequence
  Synthetic oligonucleotide
tgccctcttcgaagagatag

SEQ ID NO: 2615 - DNA, 20 bp, Artificial sequence
  Synthetic oligonucleotide
ggtcactaggcacactaaag

SEQ ID NO: 2616 - DNA, 20 bp, Artificial sequence
  Synthetic oligonucleotide
tgggtcactaggcacactaa

SEQ ID NO: 2617 - DNA, 20 bp, Artificial sequence
  Synthetic oligonucleotide
caagtcttgggtcactaggc

SEQ ID NO: 2618 - DNA, 20 bp, Artificial sequence
  Synthetic oligonucleotide
aagcaagtcttgggtcacta

SEQ ID NO: 2619 - DNA, 20 bp, Artificial sequence
  Synthetic oligonucleotide
cttagctactcacccctgtt

SEQ ID NO: 2620 - DNA, 20 bp, Artificial sequence
  Synthetic oligonucleotide
gataatggcttagctactca

SEQ ID NO: 2621 - DNA, 20 bp, Artificial sequence
  Synthetic oligonucleotide
cgacctaaagacctagcaaa

SEQ ID NO: 2622 - DNA, 20 bp, Artificial sequence
  Synthetic oligonucleotide
aaacgacctaaagacctagc

SEQ ID NO: 2623 - DNA, 20 bp, Artificial sequence
  Synthetic oligonucleotide
gtacaaaacgacctaaagac

SEQ ID NO: 2624 - DNA, 20 bp, Artificial sequence
  Synthetic oligonucleotide
attatgaaccatggagtctc

SEQ ID NO: 2625 - DNA, 20 bp, Artificial sequence
  Synthetic oligonucleotide
tcgcaataagattccattgc

SEQ ID NO: 2626 - DNA, 20 bp, Artificial sequence
  Synthetic oligonucleotide
gtgcaaaacaagtttcgcaa

SEQ ID NO: 2627 - DNA, 20 bp, Artificial sequence
  Synthetic oligonucleotide
ccagtaggacttactaaatc

SEQ ID NO: 2628 - DNA, 20 bp, Artificial sequence
  Synthetic oligonucleotide
tgccagtaggacttactaaa

SEQ ID NO: 2629 - DNA, 20 bp, Artificial sequence
  Synthetic oligonucleotide
agtgccagtaggacttacta

SEQ ID NO: 2630 - DNA, 20 bp, Artificial sequence
  Synthetic oligonucleotide
gaggattgcatcacatgtgt

SEQ ID NO: 2631 - DNA, 20 bp, Artificial sequence
  Synthetic oligonucleotide
tagcgcattgagcaaaattc

SEQ ID NO: 2632 - DNA, 20 bp, Artificial sequence
  Synthetic oligonucleotide
tgtagcgcattgagcaaaat

SEQ ID NO: 2633 - DNA, 20 bp, Artificial sequence
  Synthetic oligonucleotide
actgtagcgcattgagcaaa

SEQ ID NO: 2634 - DNA, 20 bp, Artificial sequence
  Synthetic oligonucleotide
ataactgtagcgcattgagc

SEQ ID NO: 2635 - DNA, 20 bp, Artificial sequence
  Synthetic oligonucleotide
cgataactgtagcgcattga

SEQ ID NO: 2636 - DNA, 20 bp, Artificial sequence
  Synthetic oligonucleotide
ccacgataactgtagcgcat

SEQ ID NO: 2637 - DNA, 20 bp, Artificial sequence
  Synthetic oligonucleotide
agaccacgataactgtagcg

SEQ ID NO: 2638 - DNA, 20 bp, Artificial sequence
  Synthetic oligonucleotide
ttagaccacgataactgtag

SEQ ID NO: 2639 - DNA, 20 bp, Artificial sequence
  Synthetic oligonucleotide
atttagaccacgataactgt

SEQ ID NO: 2640 - DNA, 20 bp, Artificial sequence
  Synthetic oligonucleotide
tatatttagaccacgataac

SEQ ID NO: 2641 - DNA, 20 bp, Artificial sequence
  Synthetic oligonucleotide
ctgtatatttagaccacgat

SEQ ID NO: 2642 - DNA, 20 bp, Artificial sequence
  Synthetic oligonucleotide
aggacccttaagtcataaag

SEQ ID NO: 2643 - DNA, 20 bp, Artificial sequence
  Synthetic oligonucleotide
attgcaaggacccttaagtc

SEQ ID NO: 2644 - DNA, 20 bp, Artificial sequence
  Synthetic oligonucleotide
tatcccaattgcaaggaccc

SEQ ID NO: 2645 - DNA, 20 bp, Artificial sequence
  Synthetic oligonucleotide
acgaagccaaaggtacttga

SEQ ID NO: 2646 - DNA, 20 bp, Artificial sequence
  Synthetic oligonucleotide
gccctgactgtcattcatat

SEQ ID NO: 2647 - DNA, 20 bp, Artificial sequence
  Synthetic oligonucleotide
acggccctgactgtcattca

SEQ ID NO: 2648 - DNA, 20 bp, Artificial sequence
  Synthetic oligonucleotide
gaacggccctgactgtcatt

SEQ ID NO: 2649 - DNA, 20 bp, Artificial sequence
  Synthetic oligonucleotide
aaggaacggccctgactgtc

SEQ ID NO: 2650 - DNA, 20 bp, Artificial sequence
  Synthetic oligonucleotide
tgaaggaacggccctgactg

SEQ ID NO: 2651 - DNA, 20 bp, Artificial sequence
  Synthetic oligonucleotide
cctgaaggaacggccctgac

SEQ ID NO: 2652 - DNA, 20 bp, Artificial sequence
  Synthetic oligonucleotide
tggcctgaaggaacggccct

SEQ ID NO: 2653 - DNA, 20 bp, Artificial sequence
  Synthetic oligonucleotide
atgtggcctgaaggaacggc

SEQ ID NO: 2654 - DNA, 20 bp, Artificial sequence
  Synthetic oligonucleotide
ataatcatgtggcctgaagg

SEQ ID NO: 2655 - DNA, 20 bp, Artificial sequence
  Synthetic oligonucleotide
cgataatcatgtggcctgaa

SEQ ID NO: 2656 - DNA, 20 bp, Artificial sequence
  Synthetic oligonucleotide
taacgataatcatgtggcct

SEQ ID NO: 2657 - DNA, 20 bp, Artificial sequence
  Synthetic oligonucleotide
cataacgataatcatgtggc

SEQ ID NO: 2658 - DNA, 20 bp, Artificial sequence
  Synthetic oligonucleotide
ggcaagtatgctagtcactc

SEQ ID NO: 2659 - DNA, 20 bp, Artificial sequence
  Synthetic oligonucleotide
ctggcaagtatgctagtcac

SEQ ID NO: 2660 - DNA, 20 bp, Artificial sequence
  Synthetic oligonucleotide
atcctggcaagtatgctagt

SEQ ID NO: 2661 - DNA, 20 bp, Artificial sequence
  Synthetic oligonucleotide
agatcctggcaagtatgcta

SEQ ID NO: 2662 - DNA, 20 bp, Artificial sequence
  Synthetic oligonucleotide
gtagatcctggcaagtatgc

SEQ ID NO: 2663 - DNA, 20 bp, Artificial sequence
  Synthetic oligonucleotide
ctcttgtagatcctggcaag

SEQ ID NO: 2664 - DNA, 20 bp, Artificial sequence
  Synthetic oligonucleotide
caacattatatcgatgcaat

SEQ ID NO: 2665 - DNA, 20 bp, Artificial sequence
  Synthetic oligonucleotide
tgtcaacattatatcgatgc

SEQ ID NO: 2666 - DNA, 20 bp, Artificial sequence
  Synthetic oligonucleotide
acttgtcaacattatatcga

SEQ ID NO: 2667 - DNA, 20 bp, Artificial sequence
  Synthetic oligonucleotide
caagtttcgcaataagattc

SEQ ID NO: 2668 - DNA, 20 bp, Artificial sequence
  Synthetic oligonucleotide
ttagattaaaatctggccgg

SEQ ID NO: 2669 - DNA, 20 bp, Artificial sequence
  Synthetic oligonucleotide
tcactaggcacactaaagtg

SEQ ID NO: 2670 - DNA, 20 bp, Artificial sequence
  Synthetic oligonucleotide
agatgtacaaaacgacctaa

SEQ ID NO: 2671 - DNA, 20 bp, Artificial sequence
  Synthetic oligonucleotide
taaggattcaatagtgtagg

SEQ ID NO: 2672 - DNA, 20 bp, Artificial sequence
  Synthetic oligonucleotide
ggcacacctggatttcacta

SEQ ID NO: 2673 - DNA, 20 bp, Artificial sequence
  Synthetic oligonucleotide
gagcaagggtcttagtgcca

SEQ ID NO: 2674 - DNA, 20 bp, Artificial sequence
  Synthetic oligonucleotide
ttgcatcacatgtgtcagtc

SEQ ID NO: 2675 - DNA, 20 bp, Artificial sequence
  Synthetic oligonucleotide
tttatcccaattgcaaggac

SEQ ID NO: 2676 - DNA, 20 bp, Artificial sequence
  Synthetic oligonucleotide
aataatattactgccaaatg

SEQ ID NO: 2677 - DNA, 20 bp, Artificial sequence
  Synthetic oligonucleotide
tgaatcaattttcaatattt

SEQ ID NO: 2678 - DNA, 20 bp, Artificial sequence
  Synthetic oligonucleotide
ttataaacttcagcagagtc

SEQ ID NO: 2679 - DNA, 20 bp, Artificial sequence
  Synthetic oligonucleotide
gagttgttatttgcattaag

SEQ ID NO: 2680 - DNA, 20 bp, Artificial sequence
  Synthetic oligonucleotide
attagcacttctataactgg

SEQ ID NO: 2681 - DNA, 20 bp, Artificial sequence
  Synthetic oligonucleotide
tcttggtaaggcagctcctg

SEQ ID NO: 2682 - DNA, 20 bp, Artificial sequence
  Synthetic oligonucleotide
tactcatcatgatcttggta

SEQ ID NO: 2683 - DNA, 20 bp, Artificial sequence
  Synthetic oligonucleotide
tagactagttgaaatcggaa

SEQ ID NO: 2684 - DNA, 20 bp, Artificial sequence
  Synthetic oligonucleotide
aattctaaaagtcctctctt

SEQ ID NO: 2685 - DNA, 20 bp, Artificial sequence
  Synthetic oligonucleotide
tgtgagataattcaggaggt

SEQ ID NO: 2686 - DNA, 20 bp, Artificial sequence
  Synthetic oligonucleotide
attcactttataaacactga

SEQ ID NO: 2687 - DNA, 20 bp, Artificial sequence
  Synthetic oligonucleotide
cccacaatttggtcccattg

SEQ ID NO: 2688 - DNA, 20 bp, Artificial sequence
  Synthetic oligonucleotide
gaatagggctctgcttattt

SEQ ID NO: 2689 - DNA, 20 bp, Artificial sequence
  Synthetic oligonucleotide
ttttatggccctcccatcag

SEQ ID NO: 2690 - DNA, 20 bp, Artificial sequence
  Synthetic oligonucleotide
catgaatttaattctttaaa

SEQ ID NO: 2691 - DNA, 20 bp, Artificial sequence
  Synthetic oligonucleotide
cattgtggaattaaattaac

SEQ ID NO: 2692 - DNA, 20 bp, Artificial sequence
  Synthetic oligonucleotide
tttctaattcaatatcattg

SEQ ID NO: 2693 - DNA, 20 bp, Artificial sequence
  Synthetic oligonucleotide
tcctcttatttctaattcaa

SEQ ID NO: 2694 - DNA, 20 bp, Artificial sequence
  Synthetic oligonucleotide
caagagatattcctcttatt

SEQ ID NO: 2695 - DNA, 20 bp, Artificial sequence
  Synthetic oligonucleotide
caataaataggtcagaaatg

SEQ ID NO: 2696 - DNA, 20 bp, Artificial sequence
  Synthetic oligonucleotide
ctaagtttcttaaggtaaaa

SEQ ID NO: 2697 - DNA, 20 bp, Artificial sequence
  Synthetic oligonucleotide
cattttcaaatattggtatt

SEQ ID NO: 2698 - DNA, 20 bp, Artificial sequence
  Synthetic oligonucleotide
taatgatttgccctcctaca

SEQ ID NO: 2699 - DNA, 20 bp, Artificial sequence
  Synthetic oligonucleotide
ccttttaaataatttttcct

SEQ ID NO: 2700 - DNA, 20 bp, Artificial sequence
  Synthetic oligonucleotide
aaaatgttggcatacatttt

SEQ ID NO: 2701 - DNA, 20 bp, Artificial sequence
  Synthetic oligonucleotide
aaaaatgttggcatacattt

SEQ ID NO: 2702 - DNA, 20 bp, Artificial sequence
  Synthetic oligonucleotide
cctgggtattgctgtccaaa

SEQ ID NO: 2703 - DNA, 20 bp, Artificial sequence
  Synthetic oligonucleotide
tatgttcctaaggaataatg

SEQ ID NO: 2704 - DNA, 20 bp, Artificial sequence
  Synthetic oligonucleotide
ttctttgcatttatgttcct

SEQ ID NO: 2705 - DNA, 20 bp, Artificial sequence
  Synthetic oligonucleotide
tttctttgcatttatgttcc

SEQ ID NO: 2706 - DNA, 20 bp, Artificial sequence
  Synthetic oligonucleotide
ttactctgactttccagaag

SEQ ID NO: 2707 - DNA, 20 bp, Artificial sequence
  Synthetic oligonucleotide
ggagtagatttttggagttt

SEQ ID NO: 2708 - DNA, 20 bp, Artificial sequence
  Synthetic oligonucleotide
tcaactatttctatcaaggc

SEQ ID NO: 2709 - DNA, 20 bp, Artificial sequence
  Synthetic oligonucleotide
attaatttcaactatttcta

SEQ ID NO: 2710 - DNA, 20 bp, Artificial sequence
  Synthetic oligonucleotide
tcttactgattcagccattt

SEQ ID NO: 2711 - DNA, 20 bp, Artificial sequence
  Synthetic oligonucleotide
tctcagcactagggagaaaa

SEQ ID NO: 2712 - DNA, 20 bp, Artificial sequence
  Synthetic oligonucleotide
aatataaatcctatagattg

SEQ ID NO: 2713 - DNA, 20 bp, Artificial sequence
  Synthetic oligonucleotide
ctgagtcagtccaaatgaat

SEQ ID NO: 2714 - DNA, 20 bp, Artificial sequence
  Synthetic oligonucleotide
taccttgaaattgagatttc

SEQ ID NO: 2715 - DNA, 20 bp, Artificial sequence
  Synthetic oligonucleotide
tctttttgaccaataccttg

SEQ ID NO: 2716 - DNA, 20 bp, Artificial sequence
  Synthetic oligonucleotide
tcaacaattgccatggattc

SEQ ID NO: 2717 - DNA, 20 bp, Artificial sequence
  Synthetic oligonucleotide
caagacttcaggcagttgtg

SEQ ID NO: 2718 - DNA, 20 bp, Artificial sequence
  Synthetic oligonucleotide
taccaagacttcaggcagtt

SEQ ID NO: 2719 - DNA, 20 bp, Artificial sequence
  Synthetic oligonucleotide
gttaccaagacttcaggcag

SEQ ID NO: 2720 - DNA, 20 bp, Artificial sequence
  Synthetic oligonucleotide
actgttaccaagacttcagg

SEQ ID NO: 2721 - DNA, 20 bp, Artificial sequence
  Synthetic oligonucleotide
cccaactgttaccaagactt

SEQ ID NO: 2722 - DNA, 20 bp, Artificial sequence
  Synthetic oligonucleotide
tatcccaactgttaccaaga

SEQ ID NO: 2723 - DNA, 20 bp, Artificial sequence
  Synthetic oligonucleotide
tttatcccaactgttaccaa

SEQ ID NO: 2724 - DNA, 20 bp, Artificial sequence
  Synthetic oligonucleotide
ttgtttatcccaactgttac

SEQ ID NO: 2725 - DNA, 20 bp, Artificial sequence
  Synthetic oligonucleotide
tgatcagcttcttgtttatc

SEQ ID NO: 2726 - DNA, 20 bp, Artificial sequence
  Synthetic oligonucleotide
ccagagcataaaaggaaagc

SEQ ID NO: 2727 - DNA, 20 bp, Artificial sequence
  Synthetic oligonucleotide
tcacaactcttccttagctt

SEQ ID NO: 2728 - DNA, 20 bp, Artificial sequence
  Synthetic oligonucleotide
cagttaggttagtgcacaga

SEQ ID NO: 2729 - DNA, 20 bp, Artificial sequence
  Synthetic oligonucleotide
ctgctcagttaggttagtgc

SEQ ID NO: 2730 - DNA, 20 bp, Artificial sequence
  Synthetic oligonucleotide
atactgaagtctctgctcag

SEQ ID NO: 2731 - DNA, 20 bp, Artificial sequence
  Synthetic oligonucleotide
tgtgccatatttttctattt

SEQ ID NO: 2732 - DNA, 20 bp, Artificial sequence
  Synthetic oligonucleotide
agaggccctcttgtttcaat

SEQ ID NO: 2733 - DNA, 20 bp, Artificial sequence
  Synthetic oligonucleotide
aatagaggccctcttgtttc

SEQ ID NO: 2734 - DNA, 20 bp, Artificial sequence
  Synthetic oligonucleotide
cgaatagaggccctcttgtt

SEQ ID NO: 2735 - DNA, 20 bp, Artificial sequence
  Synthetic oligonucleotide
ctgcgaatagaggccctctt

SEQ ID NO: 2736 - DNA, 20 bp, Artificial sequence
  Synthetic oligonucleotide
aaatctgcgaatagaggccc

SEQ ID NO: 2737 - DNA, 20 bp, Artificial sequence
  Synthetic oligonucleotide
ctcaaatctgcgaatagagg

SEQ ID NO: 2738 - DNA, 20 bp, Artificial sequence
  Synthetic oligonucleotide
tgctcaaatctgcgaataga

SEQ ID NO: 2739 - DNA, 20 bp, Artificial sequence
  Synthetic oligonucleotide
gcctgctcaaatctgcgaat

SEQ ID NO: 2740 - DNA, 20 bp, Artificial sequence
  Synthetic oligonucleotide
agttgacatatcttcaagtt

SEQ ID NO: 2741 - DNA, 20 bp, Artificial sequence
  Synthetic oligonucleotide
taatctcagttgacatatct

SEQ ID NO: 2742 - DNA, 20 bp, Artificial sequence
  Synthetic oligonucleotide
gataatctcagttgacatat

SEQ ID NO: 2743 - DNA, 20 bp, Artificial sequence
  Synthetic oligonucleotide
tgagctatctgtacaaaatg

SEQ ID NO: 2744 - DNA, 20 bp, Artificial sequence
  Synthetic oligonucleotide
gtgagctatctgtacaaaat

SEQ ID NO: 2745 - DNA, 20 bp, Artificial sequence
  Synthetic oligonucleotide
tttttccatttttctcttag

SEQ ID NO: 2746 - DNA, 20 bp, Artificial sequence
  Synthetic oligonucleotide
gtttttccatttttctctta

SEQ ID NO: 2747 - DNA, 20 bp, Artificial sequence
  Synthetic oligonucleotide
tgtgtttttccatttttctc

SEQ ID NO: 2748 - DNA, 20 bp, Artificial sequence
  Synthetic oligonucleotide
gtgtgtttttccatttttct

SEQ ID NO: 2749 - DNA, 20 bp, Artificial sequence
  Synthetic oligonucleotide
tgtgtgtttttccatttttc

SEQ ID NO: 2750 - DNA, 20 bp, Artificial sequence
  Synthetic oligonucleotide
tcatctcgggtatataaatt

SEQ ID NO: 2751 - DNA, 20 bp, Artificial sequence
  Synthetic oligonucleotide
tcaccattttgaccttctta

SEQ ID NO: 2752 - DNA, 20 bp, Artificial sequence
  Synthetic oligonucleotide
ttcaccattttgaccttctt

SEQ ID NO: 2753 - DNA, 20 bp, Artificial sequence
  Synthetic oligonucleotide
cttcaccattttgaccttct

SEQ ID NO: 2754 - DNA, 20 bp, Artificial sequence
  Synthetic oligonucleotide
tgcttcaccattttgacctt

SEQ ID NO: 2755 - DNA, 20 bp, Artificial sequence
  Synthetic oligonucleotide
ctgcttcaccattttgacct

SEQ ID NO: 2756 - DNA, 20 bp, Artificial sequence
  Synthetic oligonucleotide
actgcttcaccattttgacc

SEQ ID NO: 2757 - DNA, 20 bp, Artificial sequence
  Synthetic oligonucleotide
tcagttaggttagtgcacag

SEQ ID NO: 2758 - DNA, 20 bp, Artificial sequence
  Synthetic oligonucleotide
ctcagttaggttagtgcaca

SEQ ID NO: 2759 - DNA, 20 bp, Artificial sequence
  Synthetic oligonucleotide
tgctcagttaggttagtgca

SEQ ID NO: 2760 - DNA, 20 bp, Artificial sequence
  Synthetic oligonucleotide
tctgctcagttaggttagtg

SEQ ID NO: 2761 - DNA, 20 bp, Artificial sequence
  Synthetic oligonucleotide
gagctatctgtacaaaatgg

SEQ ID NO: 2762 - DNA, 20 bp, Artificial sequence
  Synthetic oligonucleotide
tgtgcatacccagggtagga

SEQ ID NO: 2763 - DNA, 18 bp, Artificial sequence
  Synthetic oligonucleotide
catacccagggtaggatt

SEQ ID NO: 2764 - DNA, 18 bp, Artificial sequence
  Synthetic oligonucleotide
gcatacccagggtaggat

SEQ ID NO: 2765 - DNA, 18 bp, Artificial sequence
  Synthetic oligonucleotide
tgcatacccagggtagga

SEQ ID NO: 2766 - DNA, 18 bp, Artificial sequence
  Synthetic oligonucleotide
gtgcatacccagggtagg

SEQ ID NO: 2767 - DNA, 18 bp, Artificial sequence
  Synthetic oligonucleotide
tgtgcatacccagggtag

SEQ ID NO: 2768 - DNA, 18 bp, Artificial sequence
  Synthetic oligonucleotide
tcatctcgggtatataaa

SEQ ID NO: 2769 - DNA, 18 bp, Artificial sequence
  Synthetic oligonucleotide
gtcatctcgggtatataa

SEQ ID NO: 2770 - DNA, 18 bp, Artificial sequence
  Synthetic oligonucleotide
ggtcatctcgggtatata

SEQ ID NO: 2771 - DNA, 18 bp, Artificial sequence
  Synthetic oligonucleotide
tggtcatctcgggtatat

SEQ ID NO: 2772 - DNA, 18 bp, Artificial sequence
  Synthetic oligonucleotide
ttggtcatctcgggtata

SEQ ID NO: 2773 - DNA, 18 bp, Artificial sequence
  Synthetic oligonucleotide
tcaccattttgaccttct

SEQ ID NO: 2774 - DNA, 18 bp, Artificial sequence
  Synthetic oligonucleotide
ttcaccattttgaccttc

SEQ ID NO: 2775 - DNA, 18 bp, Artificial sequence
  Synthetic oligonucleotide
cttcaccattttgacctt

SEQ ID NO: 2776 - DNA, 18 bp, Artificial sequence
  Synthetic oligonucleotide
tgcttcaccattttgacc

SEQ ID NO: 2777 - DNA, 18 bp, Artificial sequence
  Synthetic oligonucleotide
cagttaggttagtgcaca

SEQ ID NO: 2778 - DNA, 18 bp, Artificial sequence
  Synthetic oligonucleotide
tcagttaggttagtgcac

SEQ ID NO: 2779 - DNA, 18 bp, Artificial sequence
  Synthetic oligonucleotide
ctcagttaggttagtgca

SEQ ID NO: 2780 - DNA, 18 bp, Artificial sequence
  Synthetic oligonucleotide
gctcagttaggttagtgc

SEQ ID NO: 2781 - DNA, 18 bp, Artificial sequence
  Synthetic oligonucleotide
tgctcagttaggttagtg

SEQ ID NO: 2782 - DNA, 18 bp, Artificial sequence
  Synthetic oligonucleotide
gagctatctgtacaaaat

SEQ ID NO: 2783 - DNA, 18 bp, Artificial sequence
  Synthetic oligonucleotide
tgagctatctgtacaaaa

SEQ ID NO: 2784 - DNA, 18 bp, Artificial sequence
  Synthetic oligonucleotide
gtgagctatctgtacaaa

SEQ ID NO: 2785 - DNA, 18 bp, Artificial sequence
  Synthetic oligonucleotide
cgtgagctatctgtacaa

SEQ ID NO: 2786 - DNA, 20 bp, Artificial sequence
  Synthetic oligonucleotide
tttcatcagttagtcaggtt

SEQ ID NO: 2787 - DNA, 20 bp, Artificial sequence
  Synthetic oligonucleotide
cctttctatttcagaccgaa

SEQ ID NO: 2788 - DNA, 20 bp, Artificial sequence
  Synthetic oligonucleotide
tgcctttctatttcagaccg

SEQ ID NO: 2789 - DNA, 20 bp, Artificial sequence
  Synthetic oligonucleotide
gtgcctttctatttcagacc

SEQ ID NO: 2790 - DNA, 20 bp, Artificial sequence
  Synthetic oligonucleotide
agtgcctttctatttcagac

SEQ ID NO: 2791 - DNA, 20 bp, Artificial sequence
  Synthetic oligonucleotide
agtatagatgcctctcctct

SEQ ID NO: 2792 - DNA, 20 bp, Artificial sequence
  Synthetic oligonucleotide
aagtatagatgcctctcctc

SEQ ID NO: 2793 - DNA, 20 bp, Artificial sequence
  Synthetic oligonucleotide
taagtatagatgcctctcct

SEQ ID NO: 2794 - DNA, 20 bp, Artificial sequence
  Synthetic oligonucleotide
attgacacctccaactgtaa

SEQ ID NO: 2795 - DNA, 20 bp, Artificial sequence
  Synthetic oligonucleotide
gtattgacacctccaactgt

SEQ ID NO: 2796 - DNA, 20 bp, Artificial sequence
  Synthetic oligonucleotide
tggtattgacacctccaact

SEQ ID NO: 2797 - DNA, 20 bp, Artificial sequence
  Synthetic oligonucleotide
ttggtattgacacctccaac

SEQ ID NO: 2798 - DNA, 20 bp, Artificial sequence
  Synthetic oligonucleotide
tttggtattgacacctccaa

SEQ ID NO: 2799 - DNA, 20 bp, Artificial sequence
  Synthetic oligonucleotide
gttttcgcccgttacctcaa

SEQ ID NO: 2800 - DNA, 20 bp, Artificial sequence
  Synthetic oligonucleotide
agttttcgcccgttacctca

SEQ ID NO: 2801 - DNA, 20 bp, Artificial sequence
  Synthetic oligonucleotide
cagttttcgcccgttacctc

SEQ ID NO: 2802 - DNA, 20 bp, Artificial sequence
  Synthetic oligonucleotide
ctccagttttcgcccgttac

SEQ ID NO: 2803 - DNA, 20 bp, Artificial sequence
  Synthetic oligonucleotide
acactttcatcagttagtca

SEQ ID NO: 2804 - DNA, 20 bp, Artificial sequence
  Synthetic oligonucleotide
tctccagttttcgcccgtta

SEQ ID NO: 2805 - DNA, 20 bp, Artificial sequence
  Synthetic oligonucleotide
gctataggtgtcacatattc

SEQ ID NO: 2806 - DNA, 20 bp, Artificial sequence
  Synthetic oligonucleotide
ttgtagctataggtgtcaca

SEQ ID NO: 2807 - DNA, 20 bp, Artificial sequence
  Synthetic oligonucleotide
tttgtagctataggtgtcac

SEQ ID NO: 2808 - DNA, 20 bp, Artificial sequence
  Synthetic oligonucleotide
gcaatggacttagtacacaa

SEQ ID NO: 2809 - DNA, 20 bp, Artificial sequence
  Synthetic oligonucleotide
ggcaatggacttagtacaca

SEQ ID NO: 2810 - DNA, 20 bp, Artificial sequence
  Synthetic oligonucleotide
ttaggcaatggacttagtac

SEQ ID NO: 2811 - DNA, 20 bp, Artificial sequence
  Synthetic oligonucleotide
cttaggcaatggacttagta

SEQ ID NO: 2812 - DNA, 20 bp, Artificial sequence
  Synthetic oligonucleotide
cagattcctaaatacgcaca

SEQ ID NO: 2813 - DNA, 20 bp, Artificial sequence
  Synthetic oligonucleotide
tcagattcctaaatacgcac

SEQ ID NO: 2814 - DNA, 20 bp, Artificial sequence
  Synthetic oligonucleotide
gtcagattcctaaatacgca

SEQ ID NO: 2815 - DNA, 20 bp, Artificial sequence
  Synthetic oligonucleotide
gtggtcagattcctaaatac

SEQ ID NO: 2816 - DNA, 20 bp, Artificial sequence
  Synthetic oligonucleotide
agtgtcatatgtagcaatta

SEQ ID NO: 2817 - DNA, 20 bp, Artificial sequence
  Synthetic oligonucleotide
ttagtgtcatatgtagcaat

SEQ ID NO: 2818 - DNA, 20 bp, Artificial sequence
  Synthetic oligonucleotide
tatgtagctcagctcaatgt

SEQ ID NO: 2819 - DNA, 20 bp, Artificial sequence
  Synthetic oligonucleotide
cttatgtagctcagctcaat

SEQ ID NO: 2820 - DNA, 20 bp, Artificial sequence
  Synthetic oligonucleotide
ctgcttatgtagctcagctc

SEQ ID NO: 2821 - DNA, 20 bp, Artificial sequence
  Synthetic oligonucleotide
aaaatccatttgtccagtct

SEQ ID NO: 2822 - DNA, 20 bp, Artificial sequence
  Synthetic oligonucleotide
tttgcttttcagtcaggtac

SEQ ID NO: 2823 - DNA, 20 bp, Artificial sequence
  Synthetic oligonucleotide
taaaatccatttgtccagtc

SEQ ID NO: 2824 - DNA, 20 bp, Artificial sequence
  Synthetic oligonucleotide
ctaaaatccatttgtccagt

SEQ ID NO: 2825 - DNA, 20 bp, Artificial sequence
  Synthetic oligonucleotide
gcattggcttcatatttctc

SEQ ID NO: 2826 - DNA, 20 bp, Artificial sequence
  Synthetic oligonucleotide
gagcattggcttcatatttc

SEQ ID NO: 2827 - DNA, 20 bp, Artificial sequence
  Synthetic oligonucleotide
cattattctctagtgcctat

SEQ ID NO: 2828 - DNA, 20 bp, Artificial sequence
  Synthetic oligonucleotide
tcattattctctagtgccta

SEQ ID NO: 2829 - DNA, 20 bp, Artificial sequence
  Synthetic oligonucleotide
gtcttcattattctctagtg

SEQ ID NO: 2830 - DNA, 20 bp, Artificial sequence
  Synthetic oligonucleotide
agtcttcattattctctagt

SEQ ID NO: 2831 - DNA, 20 bp, Artificial sequence
  Synthetic oligonucleotide
aacttcatcaatatttcccc

SEQ ID NO: 2832 - DNA, 20 bp, Artificial sequence
  Synthetic oligonucleotide
tgtgggcctctattaagatc

SEQ ID NO: 2833 - DNA, 20 bp, Artificial sequence
  Synthetic oligonucleotide
catgtgggcctctattaaga

SEQ ID NO: 2834 - DNA, 20 bp, Artificial sequence
  Synthetic oligonucleotide
tgcatgtgggcctctattaa

SEQ ID NO: 2835 - DNA, 20 bp, Artificial sequence
  Synthetic oligonucleotide
tttatactttacccaacttc

SEQ ID NO: 2836 - DNA, 20 bp, Artificial sequence
  Synthetic oligonucleotide
ctttatactttacccaactt

SEQ ID NO: 2837 - DNA, 20 bp, Artificial sequence
  Synthetic oligonucleotide
gctttatactttacccaact

SEQ ID NO: 2838 - DNA, 20 bp, Artificial sequence
  Synthetic oligonucleotide
caacttcatcaatatttccc

SEQ ID NO: 2839 - DNA, 20 bp, Artificial sequence
  Synthetic oligonucleotide
tggctttatactttacccaa

SEQ ID NO: 2840 - DNA, 20 bp, Artificial sequence
  Synthetic oligonucleotide
ttggctttatactttaccca

SEQ ID NO: 2841 - DNA, 20 bp, Artificial sequence
  Synthetic oligonucleotide
tttggctttatactttaccc

SEQ ID NO: 2842 - DNA, 20 bp, Artificial sequence
  Synthetic oligonucleotide
ctttagtatgtcgagaactc

SEQ ID NO: 2843 - DNA, 20 bp, Artificial sequence
  Synthetic oligonucleotide
ccaacttcatcaatatttcc

SEQ ID NO: 2844 - DNA, 20 bp, Artificial sequence
  Synthetic oligonucleotide
actcatcatgatcttggtaa

SEQ ID NO: 2845 - DNA, 20 bp, Artificial sequence
  Synthetic oligonucleotide
tcactgagtttttgtagttc

SEQ ID NO: 2846 - DNA, 20 bp, Artificial sequence
  Synthetic oligonucleotide
tctggaatcttgtagaggat

SEQ ID NO: 2847 - DNA, 20 bp, Artificial sequence
  Synthetic oligonucleotide
ttctggaatcttgtagagga

SEQ ID NO: 2848 - DNA, 20 bp, Artificial sequence
  Synthetic oligonucleotide
ttcatcagttagtcaggtta

SEQ ID NO: 2849 - DNA, 20 bp, Artificial sequence
  Synthetic oligonucleotide
attcagcacttaggtagttc

SEQ ID NO: 2850 - DNA, 20 bp, Artificial sequence
  Synthetic oligonucleotide
tcccattcagcacttaggta

SEQ ID NO: 2851 - DNA, 20 bp, Artificial sequence
  Synthetic oligonucleotide
ttcccattcagcacttaggt

SEQ ID NO: 2852 - DNA, 20 bp, Artificial sequence
  Synthetic oligonucleotide
gccaggtgtcttatatctat

SEQ ID NO: 2853 - DNA, 20 bp, Artificial sequence
  Synthetic oligonucleotide
aggtcaaccaatttgctatt

SEQ ID NO: 2854 - DNA, 20 bp, Artificial sequence
  Synthetic oligonucleotide
ttaggtcaaccaatttgcta

SEQ ID NO: 2855 - DNA, 20 bp, Artificial sequence
  Synthetic oligonucleotide
agccaggtgtcttatatcta

SEQ ID NO: 2856 - DNA, 20 bp, Artificial sequence
  Synthetic oligonucleotide
aacgcaatgtatcaggcaac

SEQ ID NO: 2857 - DNA, 20 bp, Artificial sequence
  Synthetic oligonucleotide
aaacgcaatgtatcaggcaa

SEQ ID NO: 2858 - DNA, 20 bp, Artificial sequence
  Synthetic oligonucleotide
gatcacattacccatccgtt

SEQ ID NO: 2859 - DNA, 20 bp, Artificial sequence
  Synthetic oligonucleotide
tgatcacattacccatccgt

SEQ ID NO: 2860 - DNA, 20 bp, Artificial sequence
  Synthetic oligonucleotide
ctgatcacattacccatccg

SEQ ID NO: 2861 - DNA, 20 bp, Artificial sequence
  Synthetic oligonucleotide
taggtcaaccaatttgctat

SEQ ID NO: 2862 - DNA, 20 bp, Artificial sequence
  Synthetic oligonucleotide
tgctgatcacattacccatc

SEQ ID NO: 2863 - DNA, 20 bp, Artificial sequence
  Synthetic oligonucleotide
ttgctgatcacattacccat

SEQ ID NO: 2864 - DNA, 18 bp, Artificial sequence
  Synthetic oligonucleotide
gccaggtgtcttatatct

SEQ ID NO: 2865 - DNA, 18 bp, Artificial sequence
  Synthetic oligonucleotide
cgcaatgtatcaggcaac

SEQ ID NO: 2866 - DNA, 18 bp, Artificial sequence
  Synthetic oligonucleotide
acgcaatgtatcaggcaa

SEQ ID NO: 2867 - DNA, 18 bp, Artificial sequence
  Synthetic oligonucleotide
gatcacattacccatccg

SEQ ID NO: 2868 - DNA, 18 bp, Artificial sequence
  Synthetic oligonucleotide
tgatcacattacccatcc

SEQ ID NO: 2869 - DNA, 18 bp, Artificial sequence
  Synthetic oligonucleotide
gctgatcacattacccat

SEQ ID NO: 2870 - DNA, 18 bp, Artificial sequence
  Synthetic oligonucleotide
agccaggtgtcttatatc

SEQ ID NO: 2871 - DNA, 18 bp, Artificial sequence
  Synthetic oligonucleotide
tcaaccaatttgctattc

SEQ ID NO: 2872 - DNA, 20 bp, Artificial sequence
  Synthetic oligonucleotide
ccattttgaccttcttagcc

SEQ ID NO: 2873 - DNA, 20 bp, Artificial sequence
  Synthetic oligonucleotide
accattttgaccttcttagc

SEQ ID NO: 2874 - DNA, 20 bp, Artificial sequence
  Synthetic oligonucleotide
tctcgggtatataaattaat

SEQ ID NO: 2875 - DNA, 20 bp, Artificial sequence
  Synthetic oligonucleotide
atctcgggtatataaattaa

SEQ ID NO: 2876 - DNA, 20 bp, Artificial sequence
  Synthetic oligonucleotide
aactgcttcaccattttgac

SEQ ID NO: 2877 - DNA, 20 bp, Artificial sequence
  Synthetic oligonucleotide
taactgcttcaccattttga

SEQ ID NO: 2878 - DNA, 20 bp, Artificial sequence
  Synthetic oligonucleotide
ttaactgcttcaccattttg

SEQ ID NO: 2879 - DNA, 20 bp, Artificial sequence
  Synthetic oligonucleotide
ttaggttagtgcacagataa

SEQ ID NO: 2880 - DNA, 20 bp, Artificial sequence
  Synthetic oligonucleotide
gttaggttagtgcacagata

SEQ ID NO: 2881 - DNA, 20 bp, Artificial sequence
  Synthetic oligonucleotide
gtctctgctcagttaggtta

SEQ ID NO: 2882 - DNA, 20 bp, Artificial sequence
  Synthetic oligonucleotide
ctatctgtacaaaatggaac

SEQ ID NO: 2883 - DNA, 20 bp, Artificial sequence
  Synthetic oligonucleotide
gctatctgtacaaaatggaa

SEQ ID NO: 2884 - DNA, 20 bp, Artificial sequence
  Synthetic oligonucleotide
agctatctgtacaaaatgga

SEQ ID NO: 2885 - DNA, 20 bp, Artificial sequence
  Synthetic oligonucleotide
aggtgtcttatatctatgat

SEQ ID NO: 2886 - DNA, 20 bp, Artificial sequence
  Synthetic oligonucleotide
gaaaccagccaggtgtctta

SEQ ID NO: 2887 - DNA, 20 bp, Artificial sequence
  Synthetic oligonucleotide
tcaaccaatttgctattcat

SEQ ID NO: 2888 - DNA, 20 bp, Artificial sequence
  Synthetic oligonucleotide
gtcaaccaatttgctattca

SEQ ID NO: 2889 - DNA, 20 bp, Artificial sequence
  Synthetic oligonucleotide
caggtgtcttatatctatga

SEQ ID NO: 2890 - DNA, 20 bp, Artificial sequence
  Synthetic oligonucleotide
tttaggtcaaccaatttgct

SEQ ID NO: 2891 - DNA, 20 bp, Artificial sequence
  Synthetic oligonucleotide
gtttaggtcaaccaatttgc

SEQ ID NO: 2892 - DNA, 20 bp, Artificial sequence
  Synthetic oligonucleotide
ggtttaggtcaaccaatttg

SEQ ID NO: 2893 - DNA, 20 bp, Artificial sequence
  Synthetic oligonucleotide
gtatcaggcaacagaatctc

SEQ ID NO: 2894 - DNA, 20 bp, Artificial sequence
  Synthetic oligonucleotide
tgtatcaggcaacagaatct

SEQ ID NO: 2895 - DNA, 20 bp, Artificial sequence
  Synthetic oligonucleotide
atgtatcaggcaacagaatc

SEQ ID NO: 2896 - DNA, 20 bp, Artificial sequence
  Synthetic oligonucleotide
ccaggtgtcttatatctatg

SEQ ID NO: 2897 - DNA, 20 bp, Artificial sequence
  Synthetic oligonucleotide
aaaacgcaatgtatcaggca

SEQ ID NO: 2898 - DNA, 20 bp, Artificial sequence
  Synthetic oligonucleotide
taaaacgcaatgtatcaggc

SEQ ID NO: 2899 - DNA, 20 bp, Artificial sequence
  Synthetic oligonucleotide
cacattacccatccgttctt

SEQ ID NO: 2900 - DNA, 20 bp, Artificial sequence
  Synthetic oligonucleotide
tcacattacccatccgttct

SEQ ID NO: 2901 - DNA, 20 bp, Artificial sequence
  Synthetic oligonucleotide
atcacattacccatccgttc

SEQ ID NO: 2902 - DNA, 20 bp, Artificial sequence
  Synthetic oligonucleotide
tcttgctgatcacattaccc

SEQ ID NO: 2903 - DNA, 20 bp, Artificial sequence
  Synthetic oligonucleotide
ttcttgctgatcacattacc

SEQ ID NO: 2904 - DNA, 20 bp, Artificial sequence
  Synthetic oligonucleotide
cagccaggtgtcttatatct

SEQ ID NO: 2905 - DNA, 20 bp, Artificial sequence
  Synthetic oligonucleotide
aaattatttatacaccatca

SEQ ID NO: 2906 - DNA, 18 bp, Artificial sequence
  Synthetic oligonucleotide
tttatcaatatcttctca

SEQ ID NO: 2907 - DNA, 19 bp, Artificial sequence
  Synthetic oligonucleotide
gcacattctttctatacct

SEQ ID NO: 2908 - DNA, 17 bp, Artificial sequence
  Synthetic oligonucleotide
ttatagccattctatct

SEQ ID NO: 2909 - DNA, 17 bp, Artificial sequence
  Synthetic oligonucleotide
ctcaaagatcattctca

SEQ ID NO: 2910 - DNA, 20 bp, Artificial sequence
  Synthetic oligonucleotide
ttacacttaattatacttcc

SEQ ID NO: 2911 - DNA, 18 bp, Artificial sequence
  Synthetic oligonucleotide
gtttccatctactattaa

SEQ ID NO: 2912 - DNA, 17 bp, Artificial sequence
  Synthetic oligonucleotide
ctgtatacaccatccca

SEQ ID NO: 2913 - DNA, 17 bp, Artificial sequence
  Synthetic oligonucleotide
agttctactatactttc

SEQ ID NO: 2914 - DNA, 20 bp, Artificial sequence
  Synthetic oligonucleotide
tatacctttctttaaccctt

SEQ ID NO: 2915 - DNA, 442080 bp, Homo sapien
cacagcctgagagcctaagaatttggggaatatgcttccttcttctagatactggtttttaatgaaagacatagaagagtaattgtcatatagaagttatttgactctatcattgttgtctggcccatttctttagggattatttgggctaaattctaacttttctaagccattttatgaggcctttatttctaccatttttcactgtaggcattatggctcctccacctggtatgagaccacccatgggcccaccaattgggcttccccctgctcgagggacgccaataggcatgccgcctccgggaatgagaccccctccaccaggcattagaggtgagtgggagcataggggtttgatggttcagccaggcccctgaatatgtgtatcctctttttctcaatgtttctatttcctttccaggtccacctcccccaggaatgcgtccaccaagaccttagcatactgttgatccatctcagtcactttttcccctgcaatgcgtcttgtgaaattgtgtagagtgtttgtgagctttttgttccctcattctgcattaataatagctaataataaatgcatagagcaattaaactgtgaggtactgttgtatatatttttttgcctgttgattttgatgagatcttaagttactgtggatgagggtgatgcctattaagcagttgattcaaatcatattctctttaattcttaggataaaaaggttttctgctatctaactttcactttgtgcattgactggtgttggttaataatgttttcatgacccgggggtttaagtggttgtgctgcttcacacatggcctcctgcttctcatgttgctatgtcacattatctgaagggaagtggggatgggatgaaaggccttgtaaggccacctatatactgaaggaagttgtagtgaatcacagtccatgctcattacatatcaaggcatttgaaatagaagttactctttttcttgggatgttgacctcagttgatcaggttttacagtgtcctatgatcagaatagaggatgtgatactggaataatcattttctaccattgagtaagtatttatttataaattactaaatgagtggaagatcctgggtactgggaggcaggaggttgcatatttgagttgataagttgtactactgataataaagataactgacacactaaaacatacttggtacactgaaatacaaattacggttatgtccagtggtatcaccaagtgacaaactgggagctaaatagttcagaaatgccctagtctctaggtccagtttgaattggttatggaacaaagaagccatttataaaagggaagagatttttaggttttgcagctaaggtttatagtaggcagcgagggaatgattcatagtgattgtagcagttggtttaccaagcactaaagagattggtgttaactccataatactgatagactgattggaattacattttttctcttgaatttaccaggagtggttgtgaatgtcaccttttccatcttttaaattacatccttgcaggtggtaatcactcaaggaaaaggaattatcagagtaacaatagttcctgttactgacttgatatggtctctgccagaatagcttctcagattaatggccactctcaggtaaggaaaataaagaggcgaagccttagttgctttaggagatgatataatacaggtgtgacatcagtgttttcagaatttgtaaatgttaaaacaaacttcttgatttaccaaagccacaaccaaagtactttacctggatctttcaagacagagcttctcagttcagacaaattgactgatgataagacaaacacttttcctctacaaaccgtggggtagtatgtagagagacctgtgatttcttcccatactgctctggaactacttctaattatacttttttctttgtttgtttttgaaggggaagcatttctccttgcattggtttgctggtatggatggcccttagattttggcatgagtgattatgcagcctatttgaagaaaacctgttttcaggacctttttaattaaatatggcctgttacatgagttaaaggtaagttataagagctctagattctgcaagatgcttgcttcttgtagttattttgcttggtgataatacattttcttttgtctggagcttcctggactttttgagaatcctgattgtgatgatataataggagaaaacttgggatatagatagtataattgagtgtggtgaatcttttgttatggaatgctagtctaagcttctgtgtgtttccactagggacacacatcaacatatcagtcttaaaacattcttggtagttaatgcttgatgttacttaaaaatcatcctacattcttgcattaaactacatacacgtggctgggcgcggtggctcatgcctgtaatcccagcactttgggaggccgaggcaggcagatcccgaggtcagaagatcgagaccatcctggctaacacggtgaaacctcgtctctacaaaaaattcaaaaaattagccgggcgtggtggcaggcacctgtagtcccagctactcgggagcctgaggcaggagaatggtgtgaacctggtggagcttgcagtgagccgagatcgcgccactgcactccagcctgggcgacagagtaaaactctgtctcaaaaaaaaagaaaaaaaaaaaaaaaagaaaatacatacatgtctcatctaaaacatggttggtcaacaactttctgatttcctgatacacattttattaaccggctccttaaatatatccatgttgcatatcatgtttgacatgctttcattgtagcttatagaataatttcaaatagaattttgggataaaaattatgctaccttaaaataggttatgaagtatttgaggtattctctttttatatgataggtaaacttggcttggaattaaaaagattttgaaagttgcttagggagctccctgcttttgtgaactcattattccttaattatgatgtcaaatttcagaagtttgttattaacataccggtattttgctttttatagattcttgtaatagaatattacaagtagaaactgatttacatagataattatgtgaaatagtgctgcttgactaggattttcatgatctcatttcaaagattagcaaaaacaccctttacctggtatgtttacctctgatactaccttcactgatttcagcaggtagtcagttataatccatggattgaagttttgatttatttatttatttatttgagacagagtctcactctgttgcgcaagctggagtacagtggtgtgatcttggctcactttagcctctgccttccgggctgaagcgattctcctgcctcagcctcctgagtagctgggattacaggtgtgggccaccacacctggctaatttttgtatttttggtagagacagggtttcaccatgttggccaggttggtctcaaactcctgacctcaggtgatccgcccaactcagcctcccgaagtgctgggattacaggtgtgagccaccgcaccccgccatgggttgaagtttttaaatgcatgttttccggtagttaatacattgcttgattctgtcttataattgcatttcagttctcttcatcttgtccatacacataataatgcttagtatataataaagcaaggtatattttcatgggatttttgtagtgggagaatgacatctgagcctgaaataggatatttgtgttgtaactttttcagtgtcatacgataccattttttgaccacttagttgatgcctctgaaaggaagagagaatcagatcgctaaaatttgatgtgtcgtcagtgtggatcctactcagtagtgtcacaacgaggctgaaaatcatattaagtgcttttaggacagaaacgtaaactgctcaggtaaaataaccttataaagagaaataagcatatattgcagaggccttggctaggttcatgatgacacaggaccttgtctgaacataatgatttcaaaatttgagcttaaaaatgacactctgaaatccagtcagtgtgcctcactagacttttcgatttcaagattttctgcagaaaatgttttgaaaactttgaatacttaaaaatggcaggtgtagtattgcactttgctagttgctcagatacccttttttatttgtatagatattctgagttcctttttttttctacatgttgtacgttgtcgaaagctaaaaggaaacttatccttggatcacggaaggcagaggcatttggtgagatggaaacaaggatgtgtaaaaatgagacgaccacctctcggattaaaaaaaaaaagtgccagagttctagggttctaagtgatgtccaggaaggaggaggaataatatttatggagcatatattatggaacacagtgagtatagtacctgcctttaaatgaatactgttggttttttaggacagttgcttttttttcttttttcttcagctgtgtgcagttgattaacttgtacagagcctatcacacaatagatgtttaagaaatattaagtgaatgaatgaggcagcattgctaatttttgtatagtgagacagtatctcacagtccaggctggagttcagtggcattaacataactcactgcagccttgaacacctgagctcaaacgatcctttcaccttatcctccagagtagctgggactacagtcgcgtgtcaacatgcctggctaattttagttttctaatttttttagagttgggatctcactatgttgcttagactggtcttgaactcctggcctcatgccatcctcttgcctcagctggtattgtaggtgtgagccactgtgccaggtactaattttttttatgttagaaaacaagtttttaggtattttatagttacttccttatgacaatatctcatcagaatctaggcctatctgatatctgactccatacgtttataccgtgtagtcagccattcccagatagaggtcatttgagttacttagtgtttaccagcacttgtttactaccttgcgatgatatttacagtgtatttttgggtatggttttggggttatttggttgttgttaaaatgcctgtaatcccggcactttgggaggttgaggcgggtggatcacctgaggtcaggagttcgagcccagcctggccaacatggcgaaaccctacctctactaaaaatacaaaaattagcctggcgtggtggcaggcacctgtaatcccaactacgcaggaggctaaggcaggagaattgcttgaacccgggaggcggaggttgcagtgagccgagatcgcgccaatggcactccattcagcttgagtgacagaggtgagactcccatctcaaggtaaaaaaaaaaaatagaaatcagcaactgctatttgagtttacaggagtgagaagtcctctcttgcatggtgagatggggaacatttaattcaatagaaatatttgagaccaggtatggtggctcaagcctgtaatcccagcactttgggaggctgagttgggtggatcacctgacatcaggagtttgagactagcctggccaacatagcaataccctgtctcaaagatacaaaaattacccaagcttggtggtgtgtgtctgtaatcccagctactcaggaggctgaggcaggagaatcacttgaacctgggcggcaaaggttgcagtgagccgagaccatgccactgcactccagcctgggtgacagagtgagactccgtctggaaaaaaaaagaaaaaaatgagatataaagttcaaaggatgtatttattaagccaatataaagtaaagaggtggggaatgttgtagaagtatatgttgataaagggatcaggtggttgtacaataagaagggggttgcagacatggagaaacagttcttctagctcttccactttcagtatcatctgtgtgggtcactggaatcctttttcacaatgcctgcttgcccatgagttttaagaactagtacagtgtagaaatgattagtaggaaaaacttggctgggttaatttgctttgctgagccgattcaacttaaaaagcgaggtccatactaagtgcccaagaatcaagaaggaggctcacatttgaacttgatgtttagttaatgtgaatcattttctgttgaactaatgagaatacagtgaccttgagggttaggttgtacatctgaattgttcgggctgtttcctgtcttttggatgttttgtttgtatagatattttcattttatgttacatcatttgttctttggtagcaaaaattgagttgaaatgatacagttcctgaaatctatgatttcatgtttcggagatatgtatcaggaataatagtgtgggttctcatgagaaaatctggattgcattactgtgctactttggtttcttgtcagagaagttagtagtttagacctccttcagaatcctttctttggactttgtgtttcttacgttgtgccagccttgattttatttgtctgtcctctgtctttctataccatttgtttacacttaactctagaattttttgatgcatgttttcagtgtactctagtcctaaaattggtttacatttaattattggggagaatagcaagttgtcgatagtatctgtggtggcattagtgtatttctgtttcagttctttggacagtttgctagtggaaatagtcattgtatttagctctgtgagacccgactggcagattgctgtctctctctctctctctctctctctctgtgtgtgtgtgtgtgtgtgtgtgtgtgtgtgtgtgtgtatgcgcgcccgcgtttgtttccttcatgtagattgctgtgtgtgtctttttcttcataattccccttaattctgtgtgctttgaatgacactgttgttgttactgttgttttatatccattgtcacataaaactcttatcatttattcttccaggccagggactgtccttatgggtagagatacactatctgcaggaatttatttttttacgtatttttactagttgatgggaaagacattgggaaagacctgggctggatttgtgatgagctgtgtttactgagcatgatgaagtaaagctcaacgtgattactctgaagtccagccttactgtcagtctaaggactcaggatacaaatactcaaaacataaattcttagactctaaatttcacatggtttttcctatcagtacaggttaaggataatggcgtgttgtaggtttttccagtgcaatacaaggaagttggttctagatcctttagtacagttaatgttttgtagagtgtgttctatgttcactgcattggtatgtctcatctttggcatgatcttggctcaccgcaacctccgcctcttgcattcaagcacttcttgtctcagcctccagagtagctgggattacaagcatgtgccaacatgcccggctaatttttgtatgcttttgtggagacaggctttgccatgtttgccaggttggtctctaagtgatccacccgcctcagccccacaaagtgctgggattacatgcgtgagccaccgtacccagccacacctttgcttatttctactatgcatttcaagtgatcatttcaagagaataagtacttaggagctcctatgctctttttttttttaaccctgttgcttgcatcacccggttccaaccctatatgaaagtttcatgagcatgtttctgtcactgaggcagcttctccatttggcatataattgagaaattgctagtttgtggctgagacattggtttgagaggagacgtaatttatatatttagcagaatgcttaagttacatttccagagattaatttaattctacttttaattaagttaaccctttgctgtatctttacaagacgtaggtggagatttaattttgactcttagattcagttaaggtgatgaaattggcattatatagtttttgatgctgagccccacggagattaaaagatttgctaaacaccatgcaatttttgaatcacatctctaatctcacattattctgtactctattttttgcttgtatgattgatgggtctttcattatctgtgattgacattctatgagtaggtgcttttgctttgcctataagtcgttattatgaaggaggaatggtgaataagaaggtaatttagaaaagcctatattaaatataccatgaacattgaatatagcaagatcttattctctagttgttatcttagttgataaattctgtatgtgttatgtgtttgtgtatacatatgtacatattaatgatgtgggtgttgatactgtgatcacatgacaaatgactggtttatagtgaaaagctgttggggttcagagaaatgaacattcttctaaaagtgaggtagataagttattttatagttcttgcctttgagtctctgttcttctggtagaaatgttagtgtatttataacctctcagatttgtttggttctcttagtgttcttgatccaggcagttagcgatatgttggatgaattgagaaaaatgagtttttcctttcctactaactgaattagattagaaataagcagttaagtgagaaaaatagggaattagtgccagatatgttgaggtgtagtgttgacagggggtcttttaccttcagatgtttggtgcaacttagagaatgcagtggtagttgctggcccagcccatccaaacaacctcatttgtggggtgatacttcacagatgacttaaaataaatcccctgaaaataagaatctctggaagagatgacacgtgtatgtgcgtgtgtgcacgtgtgtgcgtgtgtgcacgtgtgtgtgtgtgtgtgttttggtggagtggtaggaggagggttggcttaatgatgagaatcattatttcttgaattggatgacactttccattcctgcaaagggagcgtgaggtccagccttgctaattcatgatcaaagtaatttgctgagagtagtggaaggaatgagttagcagaagatggcaaattgcattaatgagtagtaggaggaaaacaaataagcaaattttaatgtggttggaacatgttcctgagttgtatgaagggagacaggtaaattgagagtaatgttatgattgtttcatttgttggaaataaggaaaacttgcatggtttgaattgtggaacaataggtggtgtatgttaggagtcagaattatcatttaacatgtaagtttctgttttacttcagataaagaatgtcagctacctttcccatgttagcttctataccttttcttgaggtgaccataaataggtaatattgtctttcactgagattgttttaattagcgaagtgtgctgattaaatgtcttttcttgataaattattagaatgaataaaggatggtatttctagatagccttggttagtcagtgatttgtttaaatttagtgtggataagaatcacctgagggctttttaaacacagtttactgggtcctgaccttagtgtttctggcttattaggtataagtatgagaagttgatttttatcaagtttctagatgctacagatctaggaaccatacttagagtgctattatatgtcttttaatgtacactgatatggaaaaagcaatgatacatcatgttatcgcatattttaaaatgtgatcatgaccagggaatcttgaaagttgtcttatgtaataatgtaaatcaatgtagaataccatatatttttttcttgcaaggttattattaataggaatgactatttgtagccaatgtgttcaaatgcatgggaggacgtaaacacttcataatttcctggaaatacagacatatatcacttaaaataatacatttctaatataaatttaaattatctacgtgatatgaggaaacgagcttatttttgataattttcctagcagtgaatcaactatactcatttgaatctaaattaaattaaatttgagtaaattcagccatttctaaattcagtccatataaattcactttgggtaaaagaagacaaaattcctgaaaacagtagattaaaaaaataacattttaagagcaggtatgatctcaatgaatatagtgtggtaatttctgcctaatacctacccttttggaggaaggaaaggtaatcctgtttgtgtttaatgttaattactgaactctttataacttgttttatttatttattgtttgattttaagcatctgcttctggtggacttacatatgttgggtttgggaaatttcaacatacaggttggcattccagtggctatagttgtttcttgaaatttagtactgttttccaatgatgattctctttgggaataggctgttctcttttacttaaaaactgtaaaattagccacttcagttgagactcctccaggtttggaagtggtgaagaatatggatatattcagatcaaatcagtcattctctgtgatacagcaactgaacaagaaacccagacttcaaacaagcagacttctttgggttggactgaataaaatgagaagaaattacagaggatttgaaaatgtatatggcctaggaattattgaaattattttggagggtggcaacaaatttgggacattgtactttctgttttaatgtcaattgtataatgtgtaactctagtgagcatggctggataccgtggcttcacattttaggtagactgggtgttttatctactgagtgaattacagccttcggcaatgatgtcaaggtagcaacaaaacccaaaaaatccatcctttagaaattgttttaagtcacaatgatgataccttctttaaaagctttgacttactgaaataatgcttttcatttgtccaagatgagtacatagcagaatttggaaatatggttccaaaaggctaaatagactgacttttttgatatttttcccttatagggagaaagaaacattaacggtttatcagatgccttgactgtactttttactgctttgtcttcaaggcctagtgtaataattaacatctagtatgtgtttgatggatagccaatttttgcttcattggtatgttgttaccacagtcattggtagagtcaatatatgaatgaagaaagtataacaaatttgccctctagtagagtacaggcaaagtatggccgtcagtttcaccctgattttttttcctccattcttttttagggtttaggtcaagaacaagggcatttcattgtaccacatagctgagagtagggaattgggacatactgtcttgctttaaattaaagttgtctgtttcatcaagtagagaggttcctaagatattgccagatttctgactcggggtttgttaaaaatagaaaaggtagttccttaaggttgtattttattggatgcctccacctgcttcaggctagctcactggagaataaatattccaggttaaaaaaaaaaaagcatgtgttcacgtgaacttgtcctttgagcaaacctgttggaaatcaagaggtcattgctgttggagaggataagagggtgtacttgttggtgtgttaagagtagttcacaacataaaaataaatgtaaatgcatctattatatttgggttggcaaaatatattggttatttactctgttgattcctgtagtgtacataaatatgatctacaactctgtgaacaaaaaggcttgaaaaattgttctgaaaatggacaaatcatgaacagataattgaacaagaaaataagcagaaagtaaatttgtgaaatatttcaaactcatttacattcagaaacatctttttaagatcactgtgatacattcgactgtcaattctgaagagacgtataaaggaaatgccagctaaggagcaaggaaacagctttcattcatgggctaaattgcagcttaaaaaagatggaccaggattatttcctttagaaacttactgtacaaaagatactgttcaccccattagagaactgatttgaagttactcttccctgtgagggctctgtcatcttaactgtattcacatactttcaactgttccccttgctgctaacctcaggttctttagttcatctatctggcagagctgatttggggaaaacaagacaaaccttctcaggttttcttaataaataagcagttgtcatgtttcaagagttttagaaatgagcaataatcaaggaagaggacaacgattgcatacgtttataatatttagaacatcttttgccacaataaacactggaaaccacccacttgtggacaccaaacatttggatttgtatattttgtggcattccctcactctaatcctctcatccttaaaaattttcagaaatttttgcagcaacaaacactgattgcaacatatgatttagggtagatttatgaaccattttttcactgaaatacatcaacaggagtgagtagtctgagtgaccaccccagcatggagaaaactgtagtttacagattcttctggagcatttttatttctagattgcggtggaagtctaaccccccttggagatgtctgccttaaagggtctttggccagggtcctctgtagagccatagtccagatctactctatttgtgtgctccttacaacatcagaacagcaactctcaatccggattcatccccagaatgccgtctgagtcacagcgtggcaggtgcataaagaattatctactgaattgagaaacatttcaaatatataaaacttgaaatattttgggtagtctgtacaaactcaagttgacaagccaaccctgcaggaatatatggatagaaggggaaggataacatgttgaattcagctacatgcctcatcagctagaaaaccttggaagaaagaaagatagattgatacttgcctgaacttcatcaaccaataatattttttttcttgctatggagagtccactcgcctttggaagatttaccagtaaaagccctgcacatgatatacttgtgtgcacatgcaataaggacatcattccccaactcctgctagcattgtgaaagagctccaaatattcaaataatataaactttttttcgtggacatttagcttacgagtttgtttaaatatgtgggaaaattatgtttagataatagtattgaaatgagaatgtaagatacacattgaatgataaatgtgtatgaattgttcattgtgccttaggtaagccagacagtgaaattaaatgtgtaatagttgtatttttttgcataatcttggaatgtaattagttaaaagcaaacacttagattttgaacatgaatctgttaagcttgttaatgtagttgctgtggctaaataactggtttcctggggaagcttctatttgctagaattttattctggaacagttgttagaaaggaattctcaggtcaccttttaaagatatacacaattctgtattcactttttgagtgcataagggtaatagaaaatgacatgggaagcgttaattagaaaaaaaggcattttgtttatgtgcatttgaggatacagtgtttgaagtttctaaataattgttttatgacattttcttggtacatagatattgctaacaattagtttgctgaagtatgtagaaacattttaagaaatgattttagaaatataattgttaaagtacctctgatgtatattaaaaatccttttattttggtttatattgctatggatgtttttctgggggaacttaatgtatacaacttctaactaagaagttttattaatgctgctttatgtatgaaagtcatggatgtggatgttattttgtcagtggtctttctgttaaaatttacgtggtgtaagattttcttttcatgatggaattgccaaaaaggccagcctctagaacacttacatgttaagggttgggtgggatttgtattactttgtgtatataaccgacaggattgtgttactgaatcttaaccagcatagagatggctgacattttgcattttgggggacattaaattgttacacaatgatgtcattggttactgataggagtgtttagactcttagatggctttgttagtattaggcaaatattagatgtggatttaggagataagagggtggggtgttggagccctgtgtgcacatgagcatatgttgcagggcctccagacctaaatccacgtgaagatggtggtggtggtcttacctatatgttaacattacattgtaaacaggtagactactttccttttgctagtgggagtgttaaatcacctctcagaacattaattcattaaattgcccctaaacattaattgattgctggtggatatgctaaatatttttaacatctatttttctaaatgtatagatgtcatttttaattcataggggatagaaccagttttgcttgcaaaaagcaaactgttcactggatcattgggcttaatttttaggttgtggtagatataatagaaatgttcttacaatttgtagtataatactgtatatctctataaatatatatgtgactgtttttctgatagatgcaacatggtggaaatgtcatcataaatgtcggtctgcctttgtttatagttttcagatgtgtatatgcagttttttatacaacagaaaaattgccacatgagtcaaatagcataggttagaaaagttctcatttgccaaaaatatgtgactttcataatagtgagttgtttttgatttaaaatgtttctatctgtagaggcattttataagtttttatggggatactagcaatgggatgtgaaacctgagttcattagatcattgggtgataatggaacccttatgtgtatacaatatacatggttatatgttttttaaagcataggagctattatgtctgcatggttctaaatatatatacacacacgtaaacacatatctatatatctatctatatagatagatagataaatacatacatatgtagtgaaagcttttgtttcctccctcacataggcagattatttgtgtgtgtaaatgagcagctgaaggggaattttgttacatgtgtataagacagtcacaatatataattgttttgctttaattgtttagtctttgatttgtaggaattgccaacacgtatatttgtgtgtatgcaggtttatatataaatacatatcactgtataaacaacatttattgtcataggatagaaatattcttaagttgccagagatactgtatggctgctaaatgtatagtagaaaaatgttaccttttgctttttagcatctgcatacagattactaataggcgtatattgtgaccagtaaaccactagacaagggcataaacactttagtttgatcagtagaattgctatgccatgtttaaatgggatttatttggttgatgcagaatatataattgtatctagaagataaatattacaaaaatattttaatatacaatttctgtcatatttttggaaatatatttttattcaaaagtagaatcattgttgccaatagagttagcatctttgtgtgcttgtgaggtttgattttgagggttttcttggttttgttttgggttctggagttctaaaaaatgagattgtctttgtctaaacaatttttatataaaaatgtacatttttgtattattttttcttattccaacctaatcggtggcttgtcccttcctgtgtttattgggctgttgggtgcctggatagagctggagaccatttaactgctgtatgaataatagataagcgtcttgaataacatctgaatttcctaggtatgtagaaacacccaccatgcacatatatgaacatacagaatatatgaatgttaaaatatggtgaaaacaatcttttgctaatagaagtgttaacctttatttttaaaaaaaatttggtgtgtatgtagaggtttatttgattgttagttgtgtccatgtataatatgtcatctacctttacagatgtgcagaaatttgttgtatttggtggatatattttacttaaaactatagggcagaagctttttatgtttgttgaagtgaaatggcataccaaacctgtgtggtagagtgggatttttagattgctgtgtgtacagtcaggttatatctttaaaatacctattcgttatatattaatatgtagacattgctgatacatatgtatgtaaaaatcagagtatttttattaatataggcattagcttcttgattcacttgtttgttgggaagcacttggagaaggatgttgaatactttgtcatttcatctctgtgacgtacagttgtcatgtcaaccctcctatctgcgggttttgcatctgcaagcacatgcagctggaaagtacagcattggcagaatctgaaacccgagtaaagagcacctcattttcataaccatgggttctgaagagctaagggagttgaggatgcaccgattttggtatgggggtacggtacaggtacaaatccccgatggatatcactagacaactgtacaatcctctttagctttttttttgttttatagacagtgtggacgtgcatatattgcaagcatcactttgttaaactatgcttaaccctgcaaatgattttaagagctctgtgtgggtggctttcttgggtttactattaaatatctgtgtttatcatagttgttctataacatttcaactttgtaaatatgtagtttgttgataaagaggatagagacatttttcttttgttgatagattgttctttcccctttgcttagtcttcattgtgttgctgggattgtaaaagacaaattacttgcacatatttaagcttatatattaaatgtatatatgctgtcatgttagagagggagagtggttccctcccccacattttgatttaaaagtaaaaattaatttttattaaattgtttgggtcagtttcatgtaagaataatctctacattgaatggtatatcttggccgggtgcggaggctcacgcctgtaatcccagcactttgggaggccgaaggggccagatcacgaggtcaggagttcgaaaccagcctggccaatatggtgaaaccccgtctctactaaaaatacaaaaactagccggccgtggtagtgcacatctgtaatcccagctactcggcagtctgaggcagaagaatagcttgaacccaggaggcagaagttgcagtgagccaagatcgcgccactgcactccagcctgggcgacagagtgagactccctctcaaaaaaaaaaaggtatatcttattttctttgatgtactgaggttcatgatgcaattcattcttaagcatatactatagaatctttaaattatatggttctgtgttcatttgtggcatgacagtaaccaagacaatttagtaaataatcagcaaatgaaatatttaattttgaacatctagtatttctagatgtatagagagtctcacgaagtagattttttaagtatcttgttgtaaatttgttagtactgttgtcttttgcaattaatgtggcaatgaaattgattattgatacacaggctcttggagctaaacaaaatttatcgtgttttaatttggatattagaaggaggaaatgaaaagagactctctacattttacctgttattatatagcttaccattatatcagatatgaattgctttttttaaaaaacttagattaaatgtcatgtaaatgcatttagtctttccagatacacttcttgatatcataatttttatttcctgttaatattcaagatataaatgacttcattaaagagattttctactacctctaggaactatacaatattctgtatgtgttcccttggttgcatgacaatattcaagacaactttgtaaataatagataaaaaattttaatttttaacatctagtctttctagatgtatagagtctcacaaagtataattttgtaaataagtcattgtaaaatttcatggtttcattgtgttttgcaaatgtcttggcaaagaacttgataaaattttgggcttcttgacctatacatattttggtatctctttattgggttgtttagtgtaaggaaaaagttgaaagaatgtattttcaactttgaattgtaatcagaaagaaaatatattttaaccattgtttagtgcttctgttatatattgaaaacttcagtcttaattttttagttacattgttgatagggcattatataaatatacttctatagtcattgtaggaaatgtcttttataaggaaatatttcttctacctctgaattacacagttttgtatttacttggactgcatggcaacattcaaaaaacactttgaataacagataaaaatgacattttctaaagctctaggtttgctagatgcatgaagtctcagcaaagtataaatttgtaaatatttcattgtaaaatatcataaattgactccttcaagtgttcagtagtacaataggtaatcaataattggcctcttgggactgactgtaacgttttggtgtttgtatgttttgagacagagcaatagattgcctccatatcttttaaacattcaggtctcttgtataagaaaaataaccattgtggggtttttgtgcatcttatactaatatgaaacaaacaaaaccccctggatattttatccttagaaagatagaggaagacaggagaagggaatggtcattgtaaattagatagatatattgagtgttagaagattatttaaataattgttcttttgttatttgtactctttgcaaatttatttaaatgcatattcatgtatatcataagtatatattcacatgcatgtctaaatttagtggcatagatctatctcaggggtattaatctttcattcgtgtactgatttgtgttttattttcatttaaaaaattgtggaaccagtggctgggcatggtggctcatgcctgtaatcccagcactttgggaggctgaggcgggtggatcacctgagggtcaggagttcgagaccagcctggccaacatggtgaacccccccgtctctactaaaactacaaaaattagctgggcatggtggtagatgcctgtaatcccagctactcgggaggctgagacaggagaattgcttgaaccctggaggtggaggttgcagtgagccgagattgcaccattgcactccaccctaggcaacaagagcaaaactctgtataaaaaaaaaaattaaaaaaattgtggaactagtgttttatttctaagcttgcagatatttctagaattccacttactgttacatctaaatgtatgctgatttttcgttaaataataagcaggtctgtaaacattttcttttctaacctctttccatatttatatgagtatagaaaaactgtggttatgaatattttttactttttgataacttttaaaaactatcagatatgtgataatcagatagatttcaagtttacttacggtgtaaattaggaaaatttttataaagattctatccagtattgatcaaaagtataaattgtgtgtctttttaagcagcagtttggcaatgacaatcaaattgatactatgtaaaagttttgaaatgttatagctggctactggggtttttatctattccagttctcgaaaatttaccaaatataggttggctgtaaaatcataactatctgaggtatctgtcaataaatcaaagattgcaatgatgatagcttctttaacatgaatgtaattctaacagtaaaaaatttctatatggaatatgttttgtagtcctaaattgatattttatatcatttttcagtgaacaagtagttgtttacaggtgtctgtgcatatgtctcaagtttttctaactaaaatattaatagttaagtctaaaaatatgaattatacgtggggcttgtcattctgacatttaatacttcagcgtggtgataatggtgatataatatactgtttgaaattgtaacacatgagttaaaatcaaaagattgataagtacatatttgtatattgctacatgacaaaaatctaggaagaatatgattcacatgaaaattctttggaaggacatgacagacttttaacagtcctgtatagtgaaaggagaatagaacgactacttctactttctgtatctgaaattttcaaaagctatttcaaaatgaacatttaaacaacaggaaattttagagacaaccactttgtgcctgtcttcatccttgacattcaacatcctaggaacaatgggctgttgtattcaacttcttattcccaacagccattatgaatggtttttgattgatctcacaaagagcatgtgctttagacattaatgcagcgactaccatgaaacagagtattggattacctaaggaaagaagcagaggatggaatttgaggtaggtgtcaaacagtgaaatttcgtttgagaaacagatgagtgaaagaaaatagtaactgaaacattcattctataaggagagtacattttaatactggcgatgctgtatttgtgggtactgactagatcaagatgttagaggaggtgtctcttgggataagttggaagttatccttcattaatttggtataaactgaaaacagattgcttctttccttttaaagtggttgagtctctgatgggtttaaagtaggcctttggggatttatagatcattcaaaattagcaggggaaattttaaatattctctgcatctttctaaaaggtgtggtttaaagttggtgagaaagtgaaatggttgctggttgaacttgattttctctattcactatgcctggctagcctaaaattatcctaatgggtatgttcaggtgcctgatttgtatctaaatgtttctgtattggatactgtttttcttaggcaatcaggatgagtgaaaaattgatttgcagctgacctgcaaatggaatcatcaggaacatccctttctcatggagtcccttaatttacaagttaactgcaaacataggtaagaaggttctggtgctatttgggggtgaggtattggtgaggttttgcctaagctcaggaaaataatactggtacaggtgtatttcttggccaccttggaattatcaaatgagttagtctttaaaatatattttatcgaagtgaaggtatagtttggttcccagaccaaactgagggtcgggctgctatttctcgtgccccaataatgagatgcagatgaacaggggaggaagagttagagctagttacaggaagaaggcctggaaattgtcaccacaccaactcaaaattacaaagtttttcagaacttatataccttctaagctatatgtgtacatgtaagtgtgtatctaaagacataagtgatctataactaaggtctgagtcttcgagaccttcctttggagcctcagtaaatttacattaatttaaatgggtctgggtgctgaggtgattaccattatcttgtttcctactaaatcatggaggtttggggagttcctttagaacccccaataaacttgtttgtggaggcctggagagtttcttcagacccctaataaaacttgtttaatcgtgctttaaggttcaagagaggcctaggtaaaacttggtgggcttttgtgacattccaacctttgtataacaaaatggctctttcagcttttagtatttaacttaaccactccgtcaatactgaaacagttgttatggaggcctccattagagggacctggcctgccacaggtgcgcgcgcacacacagatgagagtacctttaattagtttacttatctatggtcaaacacgacaatataactaataaaagaaatgaccaggcatctaattactagaaattataaaattgacaatatgtgtgttttcataaatgtacagttttcacaaaatgttttcacatacagttctttgataaagggtgaagttcatggaaaccacagaaagatgctgatactgtaaactattaaagtcattactgaggttgtaagttgactttgctataggattgataatgggaagtgtttctaaatgttaacataacctgtaataaagttcaacatgagcattcacttaacctgccgccttagctgtttcattagagtggtatatatctcaccttacagtgtttcttctttttccttgtcaggagatgatagttccaagaaggaacattttatcgtctttgtttttaatctcaagaatggtacctaccatcagtgaatgacctgttgcagtgctttcattgaagtgttcttcgttccctcagcaatatgattgtaagggcagttgagtgctaacttgactgggagaggggcggtttggttagacaggacttgatatattctgtttttcataagcttgatgtttttttctggcagctacttgacattcagatctgattggttacatattgctatgtaataaattatcctgaaacaggggcataaacaatattgttatgtccatggattctgttggtctgaccatgcccaggacagtttaggaattgtatcctctccaaagtttcattgtagcttctgtgtttttagtatagttactatttctttctcatcaaatagactgaactccttttgttattatcatttaaatatttaggcattgttgtcatgtatattgtgcataaatgcatgtatactgcaggtaataattctgtatgtgaacaagtgacctagaggtaaaggaatccaaatacagagacgtgtggataatgtgggagaggtcagtttttcacaagacataggaaagaggctgggcgcggtggctcctgcctgtaatcccagcacgaggccgaggtgggtgtgtcggtcacttgaggtcaagagttcaagaacagcctgaccaacatggtgaaaccccgtctctactaagaatacaaaattagctgggtgtggtagtgtaatcccagctacttgggaggctgaggcaggagaatcgcttgaacccgggaggtgaagattgcagtgagccaagatcacaccattgcactccagcctgggcaacaagagtgaaactccatctcaagaaaaacaaacaacaacaacaacaaaaaagaaggaaagagctaacatctgacctcctttattattagaatactccaaaaggaattttgatccacatgctctttcttcataatagaatgaatgttgcatgtcattttacagacaaattttattagttcttgctgatgatataaactttgcttctaaccttttcccattttcccaactgtgtctctcaggtgatgactgaaaaagggaaactgtgccactatttgtaccatcattttcaccaaaatctaaaaatgctttttatgacgtatggagacattcttcatgtttgtttcagtggacactccttgcagatgtaaaaaactgagaaaactcacttttggaaagtgacctaaagagtgtcattgaagtgaattttaagtaggcacgatgattgttttcatggttgctgttggatcatatctcaggagctggaatgacagacattattgaacaaagaaatcaggatagtggaacttaaagggcttcatctcagtgctttcataagtatgaagtgcatatatttataattttcactaatcacagggtaaatataaaattgattcattaaaaatgtttcataagaattcaaaggacatagaattttgtgaaatgtagtatttttacttaagtgccttttctctgcttctaccccacagccaattttttataaaccagttgataacataagtagtttttgggggatgatacattacttatacattttctatgtagtaaacatgtatgtgtatgtgtgtgggtgtgtgtctaattactttgttggacagattcctgtggtttggaactgctggggccaagtttatacaaaaatctacatttttgagtaaactccccatgactctagtaagtttccacagtatttgagtattctttatttcctaaagctgtacaaacatcagataatcaatatttgtaaggatcgataatataatttataatgaaattgctttatcagctattaatgttaactacatcatcttcatatagccttataactcatttgtgctattccattttcctctgttccttttattttcacttcccttgtaatgttagtctctttgtactgatttctgaagagttcatttatgattaaacatgttaacattttgtctagaattgcaaatatgttttttctcattcattttactatggtgttttattttttggttatacagaagttgtatattgaaatataatcttgttctgttttatgactttggagttttgtggttttttaaaacatgtttacattggtatcatttatttgtattgccttctatttcagcagttagtttgtcatttctttttccattaatcatcattctggtgttaatgaatgcattaaatatttaaagtactcactttgacccgtgtagttatctgttaagttctaccataaagaaaatttccaggtaaaattggctacatttctgttaacttgccttaccattttattgacactttaataattactaatgatttatactgtcttatctattccattgagttctatctcatttctcttctttttcagaatattccctctgtatacttgcatttttttctatcaattgacgcttacaattatttttgcaagttggaaaaaaatgcagtattaatttcatttgcaacaaatttaatagattaattaggagagaatagatatctttaaaattgagtcttctgtccaactgcaaggtaggtctttctatttttaatggaataataatttggggatattgctagtgcagttttttaaagtattttttaatactaggcattttttagttatttgttaatttagtgatttggattagtcattcaacttgtctaattggtatgtgaaaactttttgtatgtcttttctagtaatctttactgaatttctaaaattatgactttcttgaacaatctgtcattttaattaccttgattaaagtacatttgtaagtacttctaggatatatggaagtagaaagtatacttggcaattggactgttaattgcaatccccttaggtcatggttgtttttgttcttattggtattttagtaatcttttagaagaaagatgttttaccaaatttggtgacaggtttaataaaatttctttttgtatagttgaaaaacttgtccttataattattaaggttaaaattaacatattccaaaattgaacattattccatcccatgaatgaagtaaattatattttagtatatactccttaattatagttgttataatttcatttggaatttctgaaatgattcctaaacaaacagctttatacttgttctgttatcagaggtttttaatgttttactggctctttgaaaccattttgagtatttctgacacagactagaaacaagtaatatttttctttaattattttgaaatgttggcttaaaaaggtgttgaaataatagcgtgtttttttttttaaagttatttatcttttgtccaaaatcaactaagcatttatgcaagcatgtgttttttggaacccttttttctgtttccttgttctttgtgtttttctttatgccaatatcacactgttttgataattgtagctttgtagttaacattttgaaattgagaactgtgactcttccacctttgttctttttcaggtttattttgctcatttcagtcctttgaaactctgtatgagttttaggattttttttttaatttttgcaaaaaatgtcatgggaagtttactagggattgagtctgcacattgcatgagtattattgacataaacaatactaactcttccagtccatgaacatgggatgtctttttatttatgtcatttatttctttcagaaatggtttgtaaatttcattgtacaaaaaattttctttgatcttactggttaagttactttctaagtattgtatttttaaaatgctattgcaagtggaattgttctttgaacttcttttgtgaattgttcattgctatttttgcatgctgaatttgtagcctggtattttgtggaatttatcagttctgagatttttttttatgctcccaaggaaaattttagcccgtaataatttttttggagacatagtctcactgttgcccaggctggagtgcaatggcactatctcccaggtttgaacaattctcctgcctcagcctcctgagtaggtgggattacacgtgtctgccaccacgcctggctaatttttgtgtttttagtagagatggggtttcatcgtgttggccaggctggtctcgaactcctgagctcaagtgatcctcctcccttggcctccaaaagtgctgcaattacaggtgtgagtcactgtgcccgaccagcctataaaattttagtggatgccaagagagatacttctacttcttttctgacttgggtgtcatttctttctttttgttacttgattgctgtggcaaggatttgtaatactgtgttgaaaagaagtggcgaaagcaggcatccttgcttttgtaactgatactagaggaaatccttttagtgtttaacctttgagaataatgtttgttttgagtttttcatttatagcttttactatggtgatgtgatttcatctattcctaatttgatgaatgttgaattttttattccttagtctttgtcttgctttggtaagagggtaatgctggccccataaaatgtgttggggagtgtttcctccttgaatttcttagaaaagtttgaaaacacttgttatttgttatataagtatttatttgatggaagattttttttttttttttttttgagactgagtcacgctctgtcgccccaggctggagtgcagtggcgcgatctctgctcactgcaagctccacctcccgggttcacgccattctcctgcctcagcctcccaagtagctgggactacaggtgcccgccaccacacccggctaattttgtgtatattaagtagagatggggtttcaccatgttaggcaggatggtctcgatctcctgaccttgtgattcgcccgcctcagcctcccagagtgctgggtttacaggtgtgagccactgcgcctgaccggaagatttttcattaataattcagtactgttaatagtttcatgcgtgtggttttgttttggtggcctttagtttcctaggtttgtaggaatttgtacatttcatctagattatctaattttttaacattcacttgcttatagtactcttacaatctcttagttctgtagactttatgtttctgatggtagcaatttgagtctgccctctttttttctagtccacttagctgaagctttgtcagttttcttgatttttgtttatgaagaaccaagtggttattttgtgttcattttctgttttattcatctctatatcattctttatgtccttccttttcctctttgtgtttactttgcttgtgtaattctttaatttgtacagttggttgatttgaaattttttttcatgttacattaataggtgtaagattcataagaaaacatgttttattttcattttcattcattcccacatattttctaattttccttataacctcttggtgtactagttgtttgtgttttctcatgtccacaaatgtgtgacttttccaaggctttccttctgttactgatttctaaattcattgtcttgctgtggtcagagaagaggcttctttttctgtctgttttttcaaaatttattgagactgaatttgtgaattaactacatttgttgtgaaaaatatctcatgcacttgaaggggagtgtgcattttgttgttcagagattgttgtgtgcatatctgttagatataattgatttattgtgatattacacacttctattttctctttttttgtggggtgaggggtgagacagagtctggctctatcccccaggctggagtgcagtggtgtgatctcggctcactgcaacctctgcctcccagattcaggcgagtctcctgcctcagcctcccaagtggctgggattacaggtgcctgccaccacacctggttaatttttgtatttttggtagagacagggttttgccatgttggccagggtggtctcaaactcctgaccttgtgatccacctgcctcggcctcccaaagtgctgggattacaggcgtgagccaccacacctggcccacacctctattttcttgttttctggttattctacccatcattgagagtaggttcttgaagtctatatttcttagtgaggaaatgtctatttctcccttcttttatgtcaatttttgtttcatatattttgatggtttactaggatcataaatgttggtcatctttatcttgtaatttttattaatgtataatgtacatttttgtttgttgtaacattttggattaaaagtctgttttgtctgacttaagcagtctacaaaataactgcttctgtaacaccttctctcctacccctttcagttgatgctacaaaattatatgtttaacattgtgtatcaaaatatatatatatatttgagatggagtcttgctctgtcacccaggctggagtgcagtggcgtgatctgggctcactgcaagatccgcctccagggttcatgccattctccttccttagcctcccgagtagctgggactacaggtgctcgccaccacgcctggctaatttttttgtatttttagtagagacggggtttcaccatgttagccaggatgatcttgatctcctgaccttgtgatccgcccgcctcggcctcccaaagtgctgggattacaggcttgagccaccacacccggcccaaaatatattttgtaaaatttattttttgttaaattttttagaagataacttgtagagttataatcaaagttacaataatatttactggttttttgcctaatgtgtggttttataattgatcaattcaagtcatgtagaatctaaaaaaggcaacaggctgggcatagtagctcatgcctgtaatacccagcactttgggaggctaaggaaggaggattgcttgagaccaggagtttgagaccagcctgtgcaacatagcaagaggctgtctctacaaaacaaattttaacaacaaaaaatagctgggtatggtggcatattcctgtagtcccagatactcaggaagctgagatgcaagggtctcttgatccctgaaggttgaggctacggtgagccatgatgatgccactgcattttagcctgtgcaacagaatcagagcctgtttcataatgaaaaacaagtggagggacagtacaccattattaacctctcataattgctcaattatttacctttaaccacatctttatttctttatagggcttccatttactatttatttcaaccttcaggagtcttttcagtgtttctgtttggtgggggagcagatctaatgtaaacaaactcctgttgtttgtacatctgggaacgtatcaatttctcccttactttttaattaacagttttgttggatattagattcttagttgagtatttttttttttttagcacattgaatgtgtcagtccactaccttctggccttatgagaaattgactgataatccctgttacatgatatcgtttttctattgttgctttcagaattctttctcttttgctcttcatagttgaaagatattgtgtctcattgtgggtctttgagttcatcttgcttggagtttgttgaggttcttagatgttagaattcatgtctttcatcaaatttgagaagtttccatctagaatttcttcagatattctttctattgcatgctttctcttttctgggaatcctgcatcgtttgtattggttagcttgggtggtggaccagaagctgtttagactcttacctttcttcaatattttttctttttgttcctcagaattgataaaattctgaagtttgctgatcttttttgttgcctgctgagataatgcatttgaatccctgtagaaaatttttcatttcagttaattgaatgtttcatgttccagaatttcatttggggttcctttttgaaagtttttttatttttgattattgatccttccattttgctcatgcatcattttcttaaccttctctatcacttcctttagttctttgagcaactttaagacagttgttttaaaagctgcttacctgtcttaccatctttgagatcagaagtggtaaactgatgagagcacagcctctcaatgtttgtataacagagtggtgtgttttgttttttgtttatgcctaccatcactccttctgcaagctgtatgtaagttgtccaagaaatgtgtacagctaccttgcgtgagggtgtaggagttagggataggtaatttgtactttgctaagagttgatgttgagtgaaattaacctcaataaatctgaatttagggttaatacaatcctccagagttccaaaccagttatatcataccgattattctggtgtatttatcatctcagggggagaaagagttctgttgcgtcctgctctgccatactcccagaatcctcagctcaccagttttttagtttgtttgttttgtttttgtatggatacagtttctcattctgtctcccaggctgtagtgcagtggcactatcatagctcactgcagcctcgacttgttgggcccaagggaccctcttgcctcagccttctgagtagctgggactatggacatgcccgaataatgtttcttttttaaagagatggggtcttactacattgcatagcctcatctcggagttctgcactcaagcattcccccagtctcagcctcacaacgtcctgggattctaggcgtgagtcactgtgcccagcttgttttacagtagtgaaatgaatctgcccatttatactttctgattatcaatgaaagttgtgttctataattttgttgcttttcagttgtgatagtttatgcatcacataaaatttgccatattaaccagatttaattgtactactcattagcattaaatgcactcacagtgttgtgtaactaacaccatattcaaaacttttgtcatcttaattggaaactctatacctgttactctaatccctagtcccttgtctccccaatcatgttttctgcatttgattttgcctattgtaggtatttcttacaagttgaatcacatagcatgtgttttttggttcctggcctattttacctaatgctttcaagtttcatgtaatacatgagaacttcatttcttattatgaccgagtaaatccattttgtgtatgtatacatgtgtgtatacatgagtgtgtgtgtatacacatataacacaatttttatccatctgctaatggatagaattttaaatctattcctctgctaatggacattttatatgccagtgctcaccaaaacattcacagtgtccattaagagatgaatacatttaaaaatatgtccattaatatttgagtgagcattggcatacaaatatctgagttcatgtcttcgtatctgattatgtatataggggaatgaaattgctgagttatgtggtaatttaatgaactcactttttgaggaaatatttgttatttattatgagaaattgaagtcaccaaaaatgagaactgaataatgaaccttctcatatctagcaactagagttaataactatgaacattttgccatattttgaaaattacagttaccatggtgatttaatcctgaataggtttatatttttatgtatcaatttttaaaataatcacaatatcctatctctacctagtaaaatttactaaaatcccttatgtgtcttctaaacacacaaagaaaaaacaattctcatttaaatttctcaaggttgtgcatggtgtctcaagcctgcaatcatagcatttttggaggccaaggcattttgcttgagcccaggagttccagatgagcgtaggcaaatagtgaaacctgttttcacaggaaaaaaaaaaaatgaggtatggtggcatgcacttgtgaacccaattatttcagaagctgaagcaggaggatcacttaagcagtaggctacaatcacaacactgaactccaggctgggtaacagagtgaaacattggctcaaaaatataaaaaattctcagttgtgcgaatgatacaacagttttttgagcaaatctggatccaagtgagtaattcacttttatctaggctatttttatgttagtcttgactgtattaatttatattcaatcttaaatctctcttaattaaggtatgaaagtcaacccttttttggttctatatttaagtaatttttaaaaaaatcttgaattaaaaacattatttagaagtaactttcatattctactggatttcttatttgctggtttttttggggggattgattctaccctttatttttagtattctgaatgagttttggtgagctactgtggtccaaaatatatattgtgtatacacaatacatagtctgaattcttgtataacaaaagtacagtccatatttgtaaggggtgcttggaaaggtatattaggtatattaccttacatgtgtagatcttcataagtaatagttggcaaggtctgctataaacttgttacatatttctatatttgtcattatattagagacatttttagtctttgatgttatttttcccattaatatggtgtcctgacctggtcatgctttcagtttttcatgagatcatgctaatgaaatttcttaaaagttttgcaaatataatctgataacgtactttgattttttgaaaaaaagtcatctcttacccagtaaatatcaactaattgctggttttcttttgtgatttcttctcaatgtattttatattaaggtttggagataccagtccttttaagcctaatcctcatgctatctggtaaaaattattaacaactaaaaattacttaatgtatattacaaaggaggtagtaccatctatgaaatctttttgataaatcttactccactctgtcttatgtatgtttaaatgagcaccagaagaattatgcattacatttcatttgattggttaatctttgagctcttggtttttaatatttgtttcttgctgttttctctttgaggaaatgagttatttgcgatataaaactttcacatttctacattgtgcccatagtaggatgccacccctgtggtcatgtttaatagttttttctcagtgtttcggtgtttaatattttctatcatttttttaaaaaaatattcaacattgagacatttttctcaatgtattatattctcaagatctgattttttgtctgactagttttatcaaatcattaattcagccatttattatatgaacaccttttgtaaaacagaagaacactaatttatcatgatattttcatatatattttgtgatattgagaatcattaagtattttatcacctgctttttacaaaaacacaatagtctctcatttcactaatagttatacatttgctctaagtatcagtaaatttactctgaatgataagttcttcatttaaataggaacttaatcaacttttttgggatttcagttcaaaaggaaaggtaaataaatgttttttcccttatcttaccatttatataataatgaattgatgtgcaagtaatcttcaaaggtgactagtttttaaattcatgttctttattcagaagacagaaagcattttcaggagatttgaatatttgaagttatattttaaaggtgataatgctaatagcataattaaaaaacagtttctgcatgtaaacacatggtagaatataacaggtaatatatatttgtaattatttttctatttcatgtttattcaaatgtatgtacaatctctgtagcttgtagtttggctgtgttatgctttataaaatttatttatctgagacagggtctcactctgtcgcccaggctggagtgcagaggcatgatgtcagctcacagcctccacctcccaggttcaagtgattctcctgcctcagcctcccaagtagctgggactacaggcgtgcaccaccacatctgactaatgtctatgtatatattttttagtagggtcaggttttcaccatgttggccaggctggtcttgaactactgagctcaagtgattaacctgccttggcctctcatactactggaattataggcatgagcctccacacccggacataacatttattttttattttatattttatattttatattttattttatttttgagatggagttttgctcttgttgcacaggctggagtgcaatggcacgatctcgcatcaccacaacctccagctcccggttgcaagcgattctcctgcccagcctcccaagcagctgggattacagataagtgccaccacgcccggctaatttttttatttttagtagagtcagagtttcgtatgttggtcaggctagtctcaaactcctgacctcaggtgatttgcccgcctcagcctcccaaagtgttaggattacaggcatgagctaccacgcccggcccataaaatttatttttatcccagttgtgtgtacttatttacttatgtatttatttatatttatttatttgagatggagtctgactctcttccccagactggaatgcagtggcacaatcttggctcactgtagcctctgacaccagggttcaagccatcatcccacctcagcctcccaagtagctgggattttaagcatgtaccaccatgcccagctaatttttatattcttagtagagacagggtttcaccatgttggccaggctggtcttgaactcctgacctcaggtgatccacctgcctcggcttcccaaagtgctagaattagagaggtgtgagcctccataaggaatatgatttgaagggaagaggggatatgagtgtgaggtaaatgttttcctatttaaatattgaaatataaaaggctattcagtttccattcaagtaacatttggaagctttttatttcataatactattttgtgtagaaaccattactgtttgttttgtatttgtgtaggtaaaaagtattatgaaattatgtaattacagtattcactctgccaaaaaaaacaaaaataattataactcgggtatctaatgattgaacatttagtaattcttccctgacaaaaagagaaaaatattataactcaggtatctaatgattgaacatttagtaattcttccctgattataaaagtagcacatttatactttggaaaataaaacagcatgtatgggaaaaagtaataaacatagagaaattccatcacctcccttcccctctcctccaagaaaaagtggcttacgcctgtaatccaagttcttagggagccagaggcaggaggatagcttgagcccaggagtttgggacttgcctgggcaatatagcgagaccctgtttccccaccccacccccccaaaaaaagaaaaacgtaattccatattttacaggtttagtgttgacttcataaaagatggaagggaaggttatcagagtatcccattgtagtgattatagtgctcagattctagctccatacctgttagaacacattcgcaattgtcagcttaaactatatttgtatgtattgtttgtctgttttgtattaaaggcaaaagctcattatcaattagttgtatgttttaaagagttggccacaacatccatcataagacctatctaaagaggaatacatgatgtcttagtacaaaggagtagagatacaatgaatgtatttattttcatgtttcttaagagggaatgcactagcaattgacggtaaaatagatacaaatcaagtaaagaaaccagtatatttttagtcattatgtcgctttgaacaacaatttgtttaatcattttgcggtaactggttgcttggaactgccttattttttgtattcaatatatttatttatgggagtgtatacatattccagggtgttctagttcctcagggaaaatctggatgacatagaagaattttgttctttattatgagtcaatttataatttcatctttttttaaaaggcatttttcctacagctagacgttttgattgtcacttttgttgtgagaaaaaaattacaaagacgttgtaaagattgggaatgaggaaggtgacttgatcgggtatcacagacttacaaaatcttgtatgtaattagagttatgttaatggcacatttataagcaaagtaatgtcatggaatggaagacccataagttgacatgagaaacagaaagtgtattaaagttaatctgcattcatgggggcagattgttagccaaatgaataaagaattagattcatcttcatggtatgtagcatgaagaatttaaaatgaatcagaggtttaaattaactgcagaaattatagagtttcagaaaacgaatttctctccaattttgaggaaattactgatgatacacattgtagaagcaacaagaaacacaaagattgatagtaaaaatgaaattacagagttgaaaaagttgtgacatcacataagaagagtgaaacccttggtgtgtaagatataatcggggaaaaataccagttcaaaggaaaagtgacttgagcacatagttcactgaaaaaaatacacaaagtgctgttaatcatataaaaggattcttgggtttgctcataataaggataatgacaattgaaaatacaactaagatataattagtttctctactattagactagcaaaagtccagaagtttgacaacatttttttttttttggcaacatgttcggaattatggaaaatcatacgttgcttctgggcatgtaaaatgtaaaccatatgggtaggaatttaatattttgtaaatttatatctgtggcaaatacatagttcatctcctagtaatatgtagcagtaagaaggattgatggatgtttgtataccactatgtgataatgtcttggatataatgtagaaataggggagaagtcggctacaggaagtaaaaatggcaatatggtgctcagggtgcattcatcactataacagataaccattttgttaatggtgccctgcgcggtaactgaaattgtactgggctttcaacagaattttgtcaaaatgggacgctgcatgagctaataagttgtgaaataaatagggttttattgtggagtaataagtaacacaaagaagggggtttgcagtatcttaggaagaagaacagacgttcttggtaaagttcctttaatatgaaaatagcatttttaaatacttggagtagtgagtgaagaagctttctctatgagagcacggttagttcccaaataaatcccagcctcctctcttctgttaatttcttcggaaggatttgaggtagcttttgaagtatttggtcaaagttgcaaactcctcgggaggaggccaggcatggtacctcacgcctgtaatcccagcattttgggaggctgaggcgggaggatcacctgaggtcaggaggtcaagaccagcctggtcaacatggcgaaaccctgtctctattaaaaatataaaaatgagctgagtatggtgatgcacgcctgtaatcctagctacttgggaggcttgaggcaggagaatcacttgaacccagaaggcagaggttgccgtgagatgagattgtgccactgcactccagcctgtgtgacaaaacaagactcctcctggaaaaaaaaaaaaaaaaaaaaggaaacctgagattctgcttaacaattgtaaagtcagaaggtatgaagagtatttgaagttagacctgtggacaggctgattggatcttcagcagtatgagaaagtttagttaagccaaggtactatgtaaaactccaagctgtacagagctctgcctggccagctggtcagcacttgggtaatgaggaattgataaatggcaaattgcttcattgaatgattggattaatagtagcatgaatggataaattaacgggaatgggtatataaatgggtatgagatcaggaatattaatggagtcacaagtagatgatgcgtaaatgggactatatgtgtggattgatggatggatggaccctgaaatgcatttttgatggaattagggaacaagaataaatataataggaagtgtggtatgcatgtaagcatgtttgtgtgtgtatgtgtatataggttgatgcaagagtggaagggtagtaaggacaaaaactttggacagctatattgacaatgcaaaataaaaacatgaatgtatgaatgtatgaatttgacggatatgtgcttgaaagaatgaagtcagtttaggaaaggataattaacaaatctcagtaatgattgtaatcatgtgattctcacagtaactgttcaacagtgactgttaaggatgctgcgtgctcatggcagtaactcatgggcagatgtcacaaagacagtaatacctcttattgcttttatgacagcataaggttttatttttcactgtggctttgttagagttatggaaagtcatccattgcctcttaaatacgtaatggtaaattgggtaaaggaattgggtaaatcacatggttttccaaaacttcaggagatttagaagctgtattttatgttttctcaaggaaaggatgaaaaggacacgttaaacactgatagtgtctactgtaggatacctttctggtctcacaaactaggtatactttctacttaaatggaaactatccccttcacagtgggaaccaataaaaacctcacccaggtaaaaatccagcgtctcagtgatgctatctccctatcatgaggtaattcacagtaatctgtaccttaagtctcagtgtacctactgttggcccagagataggtgaaacttaaagataattgtaccttggctgcatgtagtggctcatgcctataatcccagcactttgggaagctgaggcgggcagatcacaccgtcaggagttaaagaccagcctggctaacatggtgaaaccctgtctctactaaaaatacaccacaccctggtgtggtggtgtgtgcctgtaataccagctactcagaacgctgaggcaggagaatcgcttgaacccgggaggcagaggttgcagtgagctgagatcgtgccattgcactccagtctgggcaatagggtgagactccatctcaaaaaaataataattgaaccttatttccttttgtacaatgtacaatgagcagagtcagggcaactataatacaactccaaactctaaggtgtcaaatgtgatagaaatcacttttccattgaaattttgaaatccctctggaaatacactgtgaaggctccctatactgtgctagagagtgttttactagggcctggaagatgctcactttttccttgttttccttggctgtagcttttacctctggcacactttcccaatccccttatcctacttaattatttttaaaataggcattgtggaggatgtttgttcatattttaagtcttaatcatgggcttctagtttctttggaagtaaaagtgacccattaaaaatgtaaaatgtgttatgtgcatcatgggcacaggagtttcgtggcctatatgtgattctaacttatatcttaccatggtgatcgtagaaccatgtgttgatatgtaattttcaaaagaggtgaatgcccttggcacagtaatctgtcatatttagcaaagcttccctgagagccatcataacagacccacaggaatattttcattagtaagaagtagatgtgttcagccagtaaaattttgaagtggccatgacttcaatctgagtacagagggaaagttacacacaataattcagtgattggtggataggtgcgttcaaggaggcagggttggattggtgttttcaagcttggtagtagtagtagacaggcagacatgtgagttgatggaaggatgcaagaatggttactgaaattttctttgtattatatggttaatgtggatttaataactagtcattgaaattatgtgggattggatatttaaagcccagaaagatgaatataataatcgtctaatataatttgaaatataataacggatgcatgcaaaattgggtgtattgaataatgtaagaaatagatggaaagtagaatatgagcaaatggctggatgcaagaatggagaatgcaggttttaaaaacctgttgggtgtatgtatggttatatgcacagtggaatcatttagtgaaggtgcagatggttatatgcctaggtgttatcattggatggatcaaaaatggaatgctgtatggatagatctttagattgatgagtacaaatatggctatctaaaaccttggataaatgtagggatcagggttcaggtacattggttgcataagtgatagctgcctgtttggtggctttagagtggcttaatagactgatagatgggttgattcacaaggtgatggtacaggaatttgatgactatgagaatgggctgatgcaataataaagtcatatatgtaaagttgactggaaagatggacatttgaaagccaatggtatattttcacgggcagattcattatgaaattataaaagttttgtttttgcattctcaacatgatgtgttagcaaataagcaaaaactaactgcagtgggttcacaagttagtttaattaaaatgatctttcaatattttaataatttggggactttaggaggttgaggaatgagagaacttcaccttctgtatattaactggtcgtatgtcacaattttcccatatttttcacagttatagctgaggtggtaccagtttaagaagtgagaacttcttcactgactgaaatttgcatatcaatccaaatcattgtgcttatttactatttttgtagacgtcattcttcaaaagtgctggtaagaatcagtaaccctggtgtactgtttatttttgaccagtttgatattgaatctaatttgtaatattttaaaatccaaaactatacatgaattctataaaacacaaagttgtgaatttgtggagtgattatcagttaggtgaaataaaagagataaaagggctccctaaattttgacacagttttgatatgtagtttatgcaggttttgatttaccagtcttatctactctcaccgtagtatgtaatgtcatctggactgagactataactttttatctgtatactcagtaaattttatattatttcagtaaattttattgaataaatgctctggaataaattcatcagctagagggagataagaaggaagtctggcagcctgtggaaaataaagaaaatggataggctattaaaagatgtcagagaccaaagtcattaggaattagaatttactataaatagtatgggttataatgagagtagcaggtttaattttagttccaagtgcatgatttaggatatcatcagtaagtaggtaaggtcagcagataggagttgaggaatatttcaacattgaagtggtaaaagtagggtcttaacaccctttctttcgatgagtgaatgaaaaatcttcaactattttccaacattcctgtttttcttttttttcacaagcatcttcaatagtcaaggaggacaaagacatctttcctgcaggtaaaatcattaaagactatattgtgattttgaagctgttctatttgctacgttgaggatatattagattcttatttgagttctttgaaattaaatttcttttctcatacatcctactttgtggttatgtgattattttgagtcgatattttaatcaaggactttatagttaactcttgttaataaccaacatttaatgaaatcaggcattttcttgactttagtaccacgagaagttgcacaagaagcatacagggtagcaaggagaattgatgggtggatactgggttttagtttgtggaaagatcttaatggaatacacagagtatcttattagtatttccttatattgtgtcttttaaaaaaattcttaacccctgaattggtgtataaattagaatgaagaaactacacaggaaatgctggttcaaagaataaataggtggttggttggcgtgaaaataatttggaataggagataggtattcaaatcacaaaaaaatgtgtagagaaacgaaggaaaatggcagctttatcatttgcatacagtacgtatacctggtttttgtaggttttgggttattccacatcagattgtaggagttcggttttatggagtattacttgacttgaagatgatatatttctgtcaccaggcatggctgtgtcataacctgttgtttatttccatttgcaatctcttcttctgtactctctcaggtggtgaccatgtggataataggatcatagacaaatggtggttccatctacagcatcaccgaaatgctgttgttactgcttctttctgggatcttcttgcatctttgcttctaaaggggcacaccttttatagaagtacgtccaggaatagaagtgacctgctttttcgcaagtaattgcctggaatgtttttatgtacttctctgcactctcaatacatttcatgcttccctctatttttgtatattaactcattgtatttcttaaatttatattttactttatgaatggaagtgagatttgtgtatggtaaatataattaattcaaccccatggatacgttagtcactgtccagatgatggcaagtctttctcagaagcagagggccttggtgtgccagtgattttttttccccatgtgtaagatactttttttcctcatttgaatcaggagcccacagtttttagacaagtcccaaatgaaatcttaagcatttgtgttatctggactagaccttctgtagtatcctttttgttagacctagtatatctcattgcagatcaggatctgagattgactatagttcacctctttccaagtacacaaacttggatgacatgacaactgagtgtgtaagggagagcgagacccttgcactgccatttgagcccttgtgatctcatcttgtagaacatgttgtacaatcattttattggtatcattagtgttatttggggctggaataaaaatctcagtgcaccaaagagatttcccctttatccacgttaccctggttttcctttgttttctgtttaacctaaacgggcttaatataaaatagtgcttatttggtgttttaattgtctgcttctataacataagctgcactgtccattggggaactgctcaccatattgcccaacctgtcttgataggtttatacatgggaggcattcagtaatattaattacctctctagaccagtgttagcaataacaaacacttgctagaattttaagactatataatcaatcactttgatgtcagttaatcctaccaacacaagattaaaggtttaaaaatctcatacgtgtacagccattagtgtctcctttcatactatattattttgttcattggcagctagatttttaggtagaacttgtgttcctttttgcaatgctcatttattttacctggacagaaggtgctcttctgtctcttctccaaagttaatttatctcatactatttcttgtgttaatattttccaagttcagtatgctgttctggttataagaagatcagtgtcctaatcacacacttttacattatatgaaacatcatacagagttttgtagtctgtataacaatacacagaggtagcaaaatttgtaaaagagcagactatatagtccatactgtagtaactactcaacattgccattatacgtgaaatcggctataaccaattcataaacaaatgaatttggccgtgttctagtaaaacttatttacaaaaacatgtgttaggccagatttggaccacaggctgtagatttctgacctctggcttacagcagaagtttattatgatcctggggaaggtggatatacatggaaggcagaagcgagaagatgtattccatcccatgtcatttttctgaaccctcaacgtaggaagttaaactaaaacatggggcagaatctgctttaagcctttgaattcttggctcttaaagccaggttgagggttatgtgtttttattcttttatatctccttttcacttaggcttggcaactagttcattgaaacagagccaacaagaatgagtgagtcactcagtgatatgaagcaagctgtggtcatttatctactaccttccatacctacttcctaggtttgataagtagtgtttgtagtgtagttgtcagtaacttttctcagcttacataagtttatgtggaattcatttacaaatgtgtgattattacgatagatgttattttataaatttcaaggttctttaatacagcatggacatgtttctaaatcaataaatatagcttacccacagactttttatgggatgtaaagtatgtattacaacaggtaaatccatttctctgttttgggaaagcaggttaatgttttgtttgttttgttgctgcatataatgttgcactatatatatattctaatgcagttggtctcctaattctacaggataaatgtctagctgtggcattgttggatcatcagtttcgtttcagttagatgctgtgaaattgctcttgaaaatggtgtcctctgccaccacagaacggtgttgtaatggaagtgccaattttcataaaaacttgtgtgcaacaggtattaagaatttttgaggtcgggcgcagtagctcacgcctgtaatcccagcactttgggaggcctaggcaggtggatcacctgaggtcaggagttccagaccagcctgaccaacatggtgaaatcccatctccactaaatacaaaaaattagctgggcgtggtggcatatacctgtaatcccagctacttgggaggctaagacaggagaattgcttgaacccaggaggcggaggttgcagtgagccgagattgcaccactacactccagcctgggtgatgagcgaaactccatctcaaaaaaaaaaaaaagctttaaatttttagccaatctaataggtgaaaatggcatttttaacataagtctgacttaaacaattaatggccgtggctaaaagaagaatcaaataatgatgtgtgatttataagataaggaggcagtaccccatttttcctcactctacccaaaaatcctgtttatctgagcaagaaatcattaatattttctaaatccgcttggaagttcataaacgccctaagtataccttataccagcgtttttatgactttgtatttttgaaataattttagattcagaatcgcaagaatcatgcagagcgacctgatttacgcttcacctagattgactttttattctgcatcgttgtgttcttcccccacttcctcttcttgctctcgcctccctttatatgtttatacatagcattatcattttatgtactatttgaatgatttgccgacattatcttcctgtaacccaaaacacttcaacatctactttctaagagcctgagcatcttatattgacttcggtaaaaatttcaaaataatgaaatgtgtcaatagtataaaagtataacagtatgcagtccatattcacattttacccatttttccagaggtgttctttatagcagtttcttcccttctacaacatccagaaaaggatcttctattgcattcaattatcatgtctctttagttttgtttaatctgaaacagtttcctggactttgatcacatcagtgttcttaaaaagtaatagctaacagatttaaggagatacctcagattttgaattttgtgtttcctcatgaaaaggtttaagatactcattttgagcagaaataattcagtattctcagtcttccttagtgaatcatctcaggtgacaaataatgtcactttgtctcactttgaattactttgatctcttggttcgattggtgtccactggacttttccactatagttaacattccttcataattaatttggaactatacaggtattctatttttcatcaaacttccacatagtaggtttaatatgcacaggtgacttttacctgaatcagtgttgattagaaaaaaatctgttattgcttagatgcattatttagtatcttgtactgtaaggaagagtttgtatatcatggcctgtcagaacagtcccgcaatgtgttttatgaactgaaaattctgaaagaataaggtagtgatttatatgagaatacagggaaagggttacccaaagagtctaatgaatttatgtctaaaccatagagtggaatgtgagagacacacagaactccagagttgtgatgcaaatacactgcacagtggaaggagaagaggaagtttttggtaatagtgtttcatctaatgtagctctgtaatgtatgtgtgccttcattattggaagagtgttcaacagttcacagttgaatagactgaagcatgatgctggaatctgggttcagattctagatccgtatcctacatatcaccaatgcttgtttctcaatttttgtttgtcattactttaagtctctttaatgcattagagtatccaaggttgacagtgaagggactgcatttgggagctatctgaagacaaaaacagctttttgaagtttctttcatacgtcaccttacatggcctctcgcattctctgtggagaagtttgtgtagattattcagactaccgtgcagtgactgtgttgtttaaaacctatacatatccaaactctgttttgtgttctctataactagggcattagtctcccaatagtaatcctgcatcttatgctatttaaagaaggttcccagaatacagacattcttacttttgaacaatgacttgggtagattgaggaagtggttttaataatcactttgatatatttcaaaatctggttcattattggtgaggtgcaggccacctggtattaatgaaaatgtgtaattaggaaccagtgcagtggaatcagaggcttgaacatgacctaaggcttggtcaaaagtggtgatctgaatgttccctgctctctgtatgtaactttgtacttagtcttcagtggcagggttgcagcagaggcccagtaaatattgttcattcaacgtatgaaggagaaaatggaagtaaggccaaaaattactgattgtaaacaaatgaagcaccaagtgaataaatgtacaaatagacaagtagccagtaggaaaaaaaacaataattgttacctaaagaatgaaaaccaagtggaaaaggccgccagggacattttaatatgcatattgttgctttcacatataatacagtaagggagtatcagaaaacctgaatctgcctgactaaaacataccctgttccacaaagctatatatatgagagtattgaaggtggtttaataccaaattcaaaaattcagcctcagtgtagcaaacttttaaattttccatgatataaagtaagttttaaccaacaatggaagtcacagcactaaagtacattactattatatgattctctgatggtaatagaaactgtgctgcaggacacgttttgattcaggaagaaatgtggagtaactccacagaggaattcatcctttctaagtttaaatctgaacggaacccatatgcccataccctgaagatgcatgtaagggaacaacatggcttggtctgttgaaaaaagaaaagaaccttcaattaagcattctgtgaacttgataagaggatgcagaggaacgtaaatgcactctgcatatctgtgattgaccttggaacacagtgattgccctctaaagaatagccgagtaagtactgttatcattccaccgatcaaattagagcctcttccttccagtgggagcagagtgacatagaccaaggaaagccgaggagaagattgtagccttttatttctccttatatttgttgaggttcactgctgactgataaacgatttgcacaaaaaaattcaggcctctgactcttctggtatttgatttatctagtaaagttaattccaagacaaaagtacagttggttaaaaataccagtctcatgtttatttgatggtttgaaatattctgttacattgttgtatctcgtttgtcaccttggaatatatgacaatcatgttatcttgattttttccacaagataatttgattctaaaatcgattcattgtttatcttcaggaattagagattttaaaaatgtcatctcatgtctcattcagtcatttccaagatttagcgagtgttctccctaatgccttggataagaatgccttgttcaatggctgtattttactcataattagcattccaactgctttgggtttttttagatttacaatttttatttctgcagtacttaactttctatattttatgtatattaaaacaagttaggtaggatgaagatcactggatgatataaatactaatagcaaaagtagaaataagttgtattatataagttgtacataggtgttacattaggttgtcttacatgaaagtattacaaagtatgggatttggggtgtattttgaaatccttgccagttctacttgataaagtattgaatggtatcatgtgagaggagaagaggacggaaacaggacttatgatttagacctcaacaactgctagggagggttggttttctctgagtgcatgattttttataaaaatgctattttgccagttttagatccatattaaacccacagattaaggttttggtttttaaagtgtaaataggaagcttgagctgggggggaatttggaggtagagataatacttaatcgctgtgggaaaggatgagatctagagatagagtgtatgtgggagtaggaacatatgtgtctgagaccatgctttggatgctctagcatttagatattgagaaaatgaggaagacccattaaaggagattgtggctagagttactggtgaaaaccaaagggttgtagtgttcctgaagatacatgaagagtgagattaaaaattaatggggcagcagtggcttttgcatggcattgaaaagacacagttcaatttgaaaattgagtatcattaatcgtagtgctcttattattgaaaaggccaaatcaaacaatacctttgagttgatggtctgtactataattaggttaccattgttagcccagcatagacacatgctgatacctgtgagttgctttcatcaattagtatgtgaagatgcatcccagttgtacaattttagatcctcttcatcattccacattatatgtatacaagataaaacttgatgttttcattacatcctttcaatcttctaacagcagtccttacgtagctttatcattggagtttccacttgcagtgtctctatctgtacctgcattcattggccacggtagagttttcattacggcaggattgcatttcattgttttggcttgtgtcagacatttagcaaagattgttgaggaaaggaatggatggaaggggccagctgaaagaaaaagtaacaacctaatgatggataagtgaaaaaggaatgaagaaaggatggtgctaggaatcgagggagtaaagcaagatagaatgtacaaaaggtcgaatttttaaagaaagttgtagggcaagggcaaggtgtgttgaacctacatttaaaatacaataacatcactaaagtcgaggccgggtgtggtggctcacccctgtaatcccagcactttgggaggccaaggcaggcagattacctgaggtcagaagtttgagaccatcctggccaacatggtaaaaccccatctctactaaaaatacaaaaattagctgggcgtggtggcgggcgcctgtaatcccagttacttgggaggctgaggcaggagaatcacttgaacctgggaggcggaggctgcagtgagccaagatcatgtcactgtactccagcctgggcgacaagaatgaaactctgtctcaaaaaaaaaaaaaacccatcactaaaatcagggagaaaaaaaccatcactaaagtcagggataaagtaccattgtggaaggtgttcttttccagcttaacctgaagaattgtacagtcattgtacattgtcattccctaactaatgggttagatatgagtctgtagaaaattgtttgtccaacatactttatgcctcttaacatttcacttaccaaatttcatttcattccttcattttgtgtctaacagactagaaataatgagctcctattgacagggatattttcctcttcatactttcctttaccttacagagccttttatgtagcagatatttaatttcataatgggtctaaactacttgtttagaccatggatgagtgaaattttgatgaatgagccccaatcacctgaagggtgagtaaaagaagaatttctagagacccaatatgaagtagctgcttcacacttttttgagaatgttatggcatgactgaggaaatcatagatgctgtagaccatgttgagttggattgtgtaaatatagattctggtattagggaactcagcatctgctggattagacttcttatggtgaaagtctttttttagggattaggcataaatccccactgatatttgtgcagtaatagagtatagctcctgttttctttcctgcttgtatagcctgtgccattagtgtcctctttctcactgttttctcaaaggaaaacagtcaaagaggaagccatatgcatggtagactttgtaatccgggaaaagtcaacatatttcatagtagtgcactttttatgtgttgtcagtccttagaaaggattcattttctccatattatatactactctattttaaaaatttcttgggggagaatggctgtagacaggccaatgatagaatcatagaatatagtcactgtctaattactttcaatcaagagagggaacaataaagtacaatgtatgtcgctgacttcagtgtgaccactcagtatttctgtaacacagtatttatattgctgtacggtagagttatacttatttctgtgatccagttcatttgtttaatattgggattcaaggagtgttgaagaaatgtctactgattaataacagatgggaagagtgtatgtgttttaaataagagaccaagagagacaataaggaaaataagaaggaagtgtttgtgaacctttcacattactcttacattcgggaagtccacaagacaccgtagtggagattctgaggaggtgaaaacctgtagaaaaatgctttattagtaaggagctgactaagttgtcagaaagtgttgatttttagaaggatattgagacattgggtatatagggtatatgactccttgtcttcctttcattctggcttcttaccagctgttgtgaataagtttaagatttcttctgacgttataaacttcagaaaaggtatggctgtttgttcagtttgaagtagtatcatatccgccaaagccttgttcaattgtcttgttgattcatggttctcttcagtgataatattatatgggattcctacccacagccacccaatatctcagtggagaaatgcaggtttggagagaacatctgaatagaatcacgctaagatggtacatttgcactgagaccattgttatgtggcaggcagacatgaagtatcctaggattgatcagtatgccttaatgtaaatagctgcatatagacctgatttcttaggctccccacttcaagctcttgaatattgtgttgatatccttatcaatacactttgtcttgtgttctgtgttgtttttccaaaatataacgagctcctacttgacagggattttttctttctattgtcttacgataaaatgtcaagataaaaatgtatgagtttcattaaagtttattgaataaaatttgtgatggaatgagtgacagcgaggtcatgaatgagagagaatatggaaataatggagaatgtgatattctgatagtcatgcaatattctttttgatataatatgtaacatatattagtatgttatattctatgtattatttgtcatatattattactatatcctgttgctatatttggataatttgggaatctgccatgtttgatgatgttgaaaagagaacataaaatgtagtgatttcttaataaggtgtagaggtgtaggtattaactctttaagaatatagtgatttattttaaaataatgataggaaaggaccataaaaatgtctgaatttgggaaattagaaaatgttttctctctggggctttcatatgtctgttctatgtgaatgtcgctttgccatggctccctctttgctaactcttcttaacccctgcagagaaggaagtgtagtgatggtattttgagtccatcttcaggtttattgggaatgcaagggaaatgagttgttaccaatgggagtaaagggctagttgctatgccagtagctgctacttttgacactgcttgagcaatctgaatggctaggtttgaatctggcttctcagtcagaattttaccttcactctaatgctgctttttttcaaatcacctatatttacataaatatgaaccaacttcagtgatcttaattctttcccgaagatccaagtttctttccatctgcctgaagaactttctttagcacttctggtatagcagacctactgatgataatttttcttttagtatatggtgattagtttactttttattcaactgtgtctttttttgaagtcttcttcattgaaatatattgttactaaatatagaattaatggctttctttaagcacttcaaagataatccactgttttctggactccgttgatacttaagtctttatttttgtgtaattctttttctttaaatgtgccatttttcatttttctctgactcctacctactaagatatttttacctaagtattgagtcagttttggttatgatgtgactcagtgtgtttttatttatattgtttggttgtttgaacttcttgaatctgtaaatgttgtgctttatgttaaatttggggggatttcagccatttaaaatataacttttcagtctcttccccctgggactccaatttttacatatgtattagacctattaatatttttctatggatacctgacattctttttaaatcttatttttggtgtttttcactttgaacaacctaataatttgtttccatccatgttcactcactgtttattctattttttcccaatctgctcttaagcctatcctgtgaattttctttttaatttattttattttttagttccagatattttctgctttttgtttgtttttgagacagaatctttctctgtcacacagggtggagtgcagtgtcatggttcaccgcagccttgacctcctggtctcaagtgatcctctcaccttaacctacccactcctaagtagctagaactacaggtgcatgccaccacgctcagctaattttttatttttgtagagatggggtcgttgtgttgcccaagctggtcttgaactcccagactcaagcagtcttcctgcctcggcctcatgcccgcgccaaccagttctttatttttaatattatgttgtatttgatgtgctatcctattcatttagtataagcacatttttctttatgtcttcagcataattatatgctttttcagaattttaacatcaggactgcttccagggtagctttattgccctttgtcttaagtatggattatagttttcattctttgtatgtcaagtaattttggattgtaacttgaactttgaatatactgtagaaactctgaattctattttattcttctaaaacaatatttctcagcttcagcactactgacattttgaactgggtcattttgtttgtgttgttgtgtgtattttgggagggtactgttctatatgcattgtggggtactgagtattatcctttgtctccactcactacttaccagtagcataactctctctcctccccacatcccctgccaaaaaatgccttcagtcctttctaagcgctcttttttatggtgttggggccaaaatcatgcatctttactcactctttctcattgagagctatggctataaagggtagtgatacttttacttatttatttttaaggcaagcagttaacttagctggattcaaactccaggctgcctcgtgtgctgtgggaagcagcctacgctctattcagttcttttcttttcatattggttgggttactttgagtctggcctacatgatgggcagtttagaggtcaaccaaaggatttcagcagaacttatacacagaatttcattcaggcttcccgtgtctgattggctacagtgtgggaatttcctcccacttttcagccactactgaggatgcctttcggcaaaattccttgaaattggaaacttacagggaaattcctttcctccaagagtgcgctctcctccagtgttggcttgcttttggttgttctccgtggttttagatagctgtctttatattaattctggagtttacagttgatatctgttgggggcttagtttgataacatgtattcttctattactagtagccagacctgtatgtcttacttgacctgatggagaaaagtttcaacttatgagacaatactgtgctagctagttttactgatttgtactctaaagtacccaagcctaaaatagtagagctgtctatcccacatgaaacttctctgattttcactgttttttataaaaagtatacatgttcacatttctgtaggtttttttaagcatcacaatttttataaactttctatatttccaaggtctacctgctttgtattttgcctagtgagagttttgtattcatgtaggaataatctcttggtgtgagtatctattttccactcatccaaaacagatagagcattgatttcactaagcgttatgttctagtttgctttggtattattattagaaatacctggtgattaatttgagctaagtattcttctctaccctcattcccagcattatcacccgcttttaccacttccaaggggtggaagcattctccacaatgcattttttcatgccagagaaaaatctagaaaaaaatgaataaaacgaagaaattctttccccttggtatctgtagctaacttgcctaagtgttctttcccacagtttaagtcttcagtccatagttcataagcaaaggggtgtagcgagctctgatcttgccagaagagagaataagtgagctaccccacggtggacattctggccatctgaaatgagtcgatgcatgtggcttttgtctaaaggctacaaataaaatgtaaccactttcttctttgagtagttgatatagcaaatagttgaaacagaagttttgattggcaaatcaggatgtggtagatactttaacaaagagtagaactattaccagttttatgtgttgctgtttgtatctctttcacagttttgataatatcacatcctggaaagtgaaacagaaaattattattccattttaaatgactaaatttgctttcatggtatttacagtgaaagagtaaattagaaagtgaatggatgactgttcatgagaaaaagcagggtaaaaagattttatttaattaattgaaaatattagggtcaaaacataggcttatgttatgttttgtgaattgtgctgtgttgtagacatttgatgagtcctaacatagaattgatctagctcttgaaataccatttttgattgagtataaatgggatataggcaccttacaacttcagaattcgaggaagatgatgtgaatcttccaattttatctatttgattcaaatggtatgttttttcacatttctcataatttccacgtcaactcccatgatgatcatgcaggaaagcagcatgattgcacttcttgtagtgcataccatcactaaaacatagttactgtctttctgtggtcttaagaaaaattcagaaacagcataccaatgtacatataagataaataagcttatgtggtacagtaagtgttctgttctgagaaataccttgattcgtatcctaatgtctgatgttattggtagttctcaaacttccccaattctgctttcatctaaattcatcttatctatctattgttaaataatctatcagtccatttttatctatcatctatatatctgtctttatcaatcattcgtctgtaatctatctgtgccgtttggcataagagacagaagggcatagcagtggaaactcaaaggagttacctccatgtgaatggacagtggtgatggtgatctgtgaggtggtgatgtatagaaagaaaaactagaagagagcatgccctaactcagggaccttgtccagcaggcactctggccttgttatactgtgcttgaatatgaaaaaaaaaaaaatcaaaatagtgctgacattctttgtcttctgggtctgagaaaacttagagtagatatgatgactctgccatttcagtcttttgtatttccacatttagagctcagttttaattatgtagaattatttctccagcctgtgttaaactagaccatggattggcaaactttttttgtaaattgccaaatacacattttcagttctgaaagccttgtggtctttgttgcagctaatctactctgctgttgtgttatgaaagcagccataggtaatttataattgaatgagtgcgctgtgcctttcttccaataaaactttacaaaagcatcctgtgggctggagtttaccctttgggaaaccagagcattggctaaactggaacctgaaaaaataatcacatcaactcagccacatggtaataatatttagagtattatttcaacattttcattttcataaaaatttttttagctcttttgccaaattccatctgtgagtgatacaaatgactaccacgtgccattaacatcacctaaacagtgcaaaacaagcatagtagaagtaattggaatgatataaaccccttgctgtaatagttatagttgataaattatgtttcaaaattgaacctatttcttccaaatttcatctataaagttccaaggagttccaaaatcttgcctgccttcttttcccagttagcagtattgtctctgagcagccatggtggtatccatcctccttggacaatgaatttagcctattttgacttcatttgagcagttgtaattgtttcaccacatcagagtaagattactacatgccagagctattctttaactcagcttgtaaaaacatgatagcatcaacaatatacatagcaaatgaatgccatctttaatccaattaaatggtttttacaaatttgctcttgtttgttgatgctatctgcattgcagtaattaaaggtgaggtaaaaagaatgaataaactgccaagttaaaattaaatttgggcaatttctcttttgcagtaatgtatgtatatttactcaaaacatatgccaaatttagtgttgaaaggctcattcaaatcaattgggaaagcacgtaaatgaacaattcataaaagaaaagcattgcaaatggccaagagcatagaaaatgtgctcaatcttaccagtcattataaggaaataatgaaatttgtgtatatatgaaatacttaaaatatatataaaataaaacaattatttgccttttttcacctatcagattaacagattatatgtgttaacaaggtggggagaatttacaactcctgatatgttaaaatctttcaggaaggtagtagaaaatatatgtaagatggaaattagcacttttgaccaacaattttagttttagatatttacctataaggatataataggaggtgttcaaagatgcatgtaactcaatgtagtattaattataattgtaaaatagtaaataacatttttgtcaaatcataatgttaggaaaattagtgatggcacatttaaccaattgaattatattcagttctgaataccgtgatgcatgttcaaattaattgatacaaaaatccaacaactttagcagtttgtttaccagttattgagtaccaactgtgttcaacattgttatttcactcatatgaaatgataaatgtatgtgcgtgttatgatacggtcaataaaaccacttttataggaagaatactcacaaaatacagcgagttctggtcattattttattgttgcatttgtgtgtttgtgtgttttgaatacatacatgtatttcaattaactatagcatttattgaatttttatcacatgtaccagatggggagatcaacactttacatgaattataagttataatataataacttatataatgttattatataataacttattattataataacagatggaataacgaatttgtctttttaaaagataagtaaattgaggttgagtttgaattttgtaattcattctattatatagaagttaaataaacctatcctaggatgtcacaacctttggataataataattaaaaatacttatgatttattaaacccattgagcaaaatcatgttttgtgaaagaacccacatttcagaagtcatattcattcttcttttgtctttaaggccagagacatgataattattaagtgcagcttctcaggacagaaagtgtaagtgttggtatattgtaggaacaggagaaaaacatgaataggaacttgtcttttggaaattcttacagtataaacctttaaggagttacttctagaaatatggggtgcctttgctcaggatgtggaacaacatgttcccgggcagaaaccatattatacacaaagctctgagacatcatggaggcacagatgaaagtccaaagagaaatggccagtagaaagaggatcactaaatggaagaagctaactttggaatagagctggtgacaggtaatatgatgacttaaatgctgccaatagcagggaaaaggtccatggtaatatctgagtgaagaaacaattgccaactgatctagatttgaagggcataacctcttggaatatttttccagtgtaatttgtgatcatatggtctggattctacaaaatctcccccattctacaaaatctataatcagttctcttccattttcttcattcattctaacccttttctaaagacggcactttgtgtcttgtgaatgcaatcccttagcagttctcagctagtagctgaaactttggttaaaatggtaagcatgggggattgtgacataaattttgctttgctatggcagttattgaaatatttttataattttgactatttgtcatgtaaggaatgcacagtgccattctaactgtgtatattctggtatttggggggttggaaattgactatatgagattcttgcagctgggtctctgacatgttgagaatgctgaagaagaaaaagtacagaaggagaaagcagagatggggaaagctgcatccctcaaataggataccactggatactgagcagtgaacaacctctggttttgtcggacaccattttggaatatttggacacagtttccggaaggatgagagacctaatcaatggtagtaagatgtttaaaatattattaatacgaatgaatgcttaggcaaggttgacggtaaagctcttctgtacaataggtagcgttaataaagaaatgacaagatttggaaaatcagtatttggaaataatcataattgtttcagccaggaatcatcaaatgatgctaaaacttggagaaaattttaagagaaacaggacatttggtgtccttatcagttacaaagggaaagtagtagcttcctgatggagaacatggttgacagcacctgaattaaagaggtgaaagttaataccacagtagtgggaacatcaggcagcgctgataggatgcactgagaagaacacagtctcatttctgtagtattactgactaaactgcagaaacctgagtctacccatgaggaaacatcagtctcaaattgactgatattttgcttttagtattcaaacatactaatttcactgaggaaatggtccagattatttcagactatatagacatgagaatggaatatcacattggttcaggatgtctataaaaggataaggaaggttggcaaaatttgaagacagtccctcaagtagattatagtgttacgtgagtattaattgcctaagttatataattgcctgaggttatataacagaaaattcttgtttttaagaaattaaaacaatttaaaggataaagggataatgtcatagctgtaattttccaagcatttggataaaataatatacatgtttcaaaaaaaaaatgaaacagatgttgtaagatgttagcaaatagggaatccaggtggaaataatccaggaattatggatagtcttgtatctgttcagcaggtctgaaagtagttgatgaaaataatgcaaaagaacatgtcaaaaagaaatggtttgggcatatggcttcaagcatacataaatgctcaggaaacatgaaaatgtgaaataaatggatgagtactataataccagcaggccttgtagatacctgcatttgaagcatttatattagaaggaagcctttttacccagaatttttttcacttagcctaatgttttcaaggtttggccatgttgcagcatatatcagatctccattttttttgatggaggagtgatattctattgtataaatatatcacattttgctcatccactcactagtttttggctattatgactaatcccgccaggaatatttatgtggaggtttttgtgtgtttatgttttcaattctattatacatgagaatatagtaactgtgtttatttgacattttgaggacctgtctgtaagtgatgtttaagataatttttgttacatttgaaggcagataatagtctatgcaaaatgaatattctgttgaatattgatgtgaactattcttattgtaaaaaaaaagttacattgaaatagtaagtatagaagttatatcttggtggcggggcgtggtggctcatgcctgtaatcccagcactttgggaggccgaggcaggtggatcacagggtcaggagatcgagaccatcctggctaacatgatgaaaccccatctttactaaaaatacaaaaaattagctgtgcgtggtgatgagcgcctgtagtcccagctactcaggaggctgaggcaggagaatcacttgaacccaggaggcggagcttgcagtgagctgagattgtgccactgtactccagcctgggtgacagagcgagactctgtttcacccaaaaaaaaaaaaaaaaaaaaaaaaaagtattggtttttgtactcaacaagcagttttatgtttttatttttcaggaactctccaatactgaattcaggctgggatattagagaaaaggaaaatacatgaaactcagtggtgttttatggcactttgagttccccaattcaccttcaaacatttagccttccaagttctctgccaccgtatcagtgcatccctcctgagattcttaattctttgattgtgtaaagatggactatgcttactccatcttacttctcttaggtcttacaatggaagtgccctattacattttgttcttttctatgatttccaattattttatgaaatttttcatttattttttctgttctttctatctttaatttctatgtaactttttgaaatagatctcaaagattttatatatatatatatatatatatatacacacacacacagagagagagatatatatctactgtactattgaagtagattcctaaagtttttatctcttctagaatattggtttcacaacacccctattatgtgtatttaattttacccaccacatggcgttttcaaaaagtctttatttggcggaatacaacttcagaatctgattcgaagagaaaattgctcacagccgtgagccactgtgcctggccgatttttactatttaaagaaggaagaattttagcagcgtggggtggctcatgcctgtaatcccagcactttgggaggctgaggtgggcggatcacttgaggccagtagttcaagaacagcctggccaacatgacgaaaccccatctctactaaaaatacaaaaattagccaggcgtggtggcacgtgcctgtagtcccagctactcgaaggcttaggcaggagaatcgcttgaatcagagacagggaggctgcaatgagccgagattgcaccactgcactccagcctgggcgacagtgcaagactccatctcaaaaataaagaggaattggaggaggaaataaatgaataaatgacaaaggtgacaaaggaccaaagatctgtgacttgtgcaaagattgctctgtggtaattattacagaaacaatgtttgtatcttattttttagggaattttgtatattgtctaatctgatttactttgtttttaatagtttgctgcaggtctagaagatgtcacagaatttcaaggaagagaggtgagcagctgctgtggtgattttgaaattgtttgtgtgtgttgtggccagtgatgtcagaatttcaggatctgagagttcatgattttagaggctcaaaggagaatatttttataacttttttctataatttttttataatttttttatatattttttataatattttataattttttttgctatgtgagtatccctactttgttcaaggaatctcattatcttttccctttttttaaaaagggatttttttgtagtaacctgaataaattgggggaagtattgatatatttccttttctcaccattttttgttggatgaaaataatcttttagtgaaattcagtgtattaaatatttattttttaaagtctagagatggggtcatgctgtgtttcccaggctgcccttgaactcctgggctcaagcaatcatcttgcctcaacctcctgagtagctgggactacaggcatgtgctgccatgcctggcttaaatatttaaaaaattttatctggcacattctgaacacagatgtttctacttatatttgtcatgtagtcacagtatatattgattttgctacctcgcctactcctaaaagttttaattcatttaattggtcttaattggacttaaaaattttttccctggccgggcgccttggctcacgcctgtaatcccagcactttgggaagccgaggcaggcgtttgagaccagcctgaccaacatggagaaaccctgtctctactaataatacaaaattagctgggtggggtggcacatgcctgtaatcccagctactcaggaggctgaggcaggagaatcacttgaacccgggaggcagaggttgcagtgagctgaaattgtgccattgcactccagcctggacaacaagagcaaaactctgtctcaaaaaaaaaaaaattcccaatagattttaatctaattttattagaacaattcagtcatatgttttttcatgctatgtatatgagagttccattattcagatactaaacaaatgtctactgtacatttactcttctcactgatgatggattagataaccatgcacaaaataagcctggctgtggaaatgcttatttgttgggagggtgcttgtttggatcgatgatgagaataattgtctgaggatgctgagggactcattccagatgtcaatctgaggtccagatgtgtggccctccaataggacaaataagactctcagagcctggctctatttggggatccctcagtgacaacatagtacctctgtgagcgtgccttttctatctctccgaagagggcattagcatcctgtcttatgagtcagtatgcactttagtatggttagtgacccaagactcactttattttgttcattttgagcagagaattgtagatagatacatatatgggaaatatgttcttgattaacaaatgaaaaaatgaaaaagtttcagtcaagaaaggtcaaggaactgtgatgtatagtgaaggcagggaacactgcatgcctgtattaaatattgacaaaggaaccaattttagtgctttgttatttttactgttgagtattttctgagaccatttctttttcttctattttgttttgctgaggtagaggagggctggaatgaggtcctccacttcagaaaataggggtgagtagttaaaccaacatcctttggaattcatatacgtcatgcgttccatgccacatcctgagatctttttgttgatttttttagtggcttactggataatatctaaatactgtatattttactttggtgagtctctccaccttcatttctgaatcattgtcctttacatttttattctatttgaattttgcatgaaatgacaaatgtagaattttgcccaatttattttatttattcatttatttatttgggaagacaaagtctctctctgtcacccaggctggagtacattggcccagtcagagctcacttcagctcttcaccctgtagcccttaactcctgggctcaagtgatcctccaccctcagcctcccaagtatctaggaatacaggtatgtgttaccacacatagctaatttttaaattttttattttgtgaagataggatcttactgtgttgctaaggctggtcttgaactactgggctcaagcagtcctcttgttttggcttcccaaagtgctaggattacaggcaggagccaccatgcctggcatcattagggatattggtctgtgattcacttttgatgatgtctttggttttgataaaaattagggtaatagtagactcatggaataagttgggaaatgttttctgctctcctgttttttggaagagttgtgaaggattgatgttatttctttaatgatttggtagaattcatcagagaaatcatttgtgtggaattttatttgtggaaacttgagtagctaattcaatctcttgttaaaggtgacttcaattttctgtttttccttcttgtgacagttcctgtaatttatatatttctaggaatgtgcctatttaatctaggttatgtaatttgttgacataacttgtttatataagggtgttagtctgattttcatcccagattttatgaaaattgggtcttctgttttcagtagtgtagatatagttatgtcaattttttaagagacagagtcttactgtgttgtttatgctggccttgaacttctgagcctaagcaatcctgctacctctgcatcttgagtaggtgggagtgtgggaacacaccaccacacctggcctgtcactaaacaaacaaaaaatttcagtgaaccagcttttgatatttttatttttcttctgtattttttattttatttattggcattttattcttatatcttttattctacttgatttagctttgctttgtttttctgttttcttaaggtaaaagtttagattattgatttgagattttcctttttttaatatggacatttacagctataaatttcccaaagaactcttttagctacatatatattttcttttgttgtgttttgtttcctttgatttcaaactattttataaattttcttatttctcccaagaactcccaatgattcttagtaatgtgttaatttccatatattgtgaattccccccaatttttttcctttatttctgatatgattctattgtggttggacaccatacttttctgatttctttactttcagatttgttgataccagtgtgtggtctaatacctaccctgcacactgttccatgtgcacttgaaaataatatattttctactggttagattgttccatagatggatgttatgtaactgttttatagtgttgtttgtcttctatttccttgatcttctgtctcattgttatgttcatcattgaaagtgaggtattgaaattttcagttattataatgtttattttgccttccattctgtcatttttaaaatttaatttgggggttatgttgttggatgcacgtatctttattattgttatatcttcctgatggattgacagtttaatcatcatgaaatgtcctttgtctctaccaacaatttttttttttttgagatggagtctcgctctgttgcccaggctggagtgcagtggcaccatctctgctcaccacaagctccgcctcctgggttcacaccattctcctgcctcagcctcccgagtagctgggattacaggcacctgtcaccacgcctggctaattttttgtatttttagtagagacggggtttcaccatgttagccaggatggtctcgatctcctgacctcgtgatccacccacctcggcctcccaaagtgctgggattacaggcgtgagccaccgtgcctggccctctaccaacaatttttatcttgaaatttatttagcctgataattgtagtttttgtctgacttatagcccataaactctctctggttactgtatgcagtttatcttgtcattattttactatctacctatttttaattaaaacaaaatatctttgagacaggatctcactctctcacccatgctgtagcgcaatggcatgatcatagctcactgcaacctgaaactcttgtaattcaagcaattcttccacctcagcctcctgagtatctgaaactacaggccaacaccaccacacctggctaatttttttgtattttttttcttgtagagatgaaatcttggtatcttgcccaggatggttattttctacctattttttgtccttgaatctaaagtgtatcttttgtagagagcatatagttgtatcatgtgtttttttaaaaagatacatctctgccttttaagtggagagtttacttcatgaacatttaatgtaattactgataaggtaaaattcacatctgccattttctattttcttttatggcatatatctgttttgtttttcttattgttctttatgttaaataagtaatagtgtactgctttaattttctttttaattttttgtgtttacttattagtggttgcctttgagattatagttaatttgttaatttataatatagcttagatttaatagttaattttaatagtacacagaaactatttttcaatatagctctgttttctcacccttccttttgtatattattgtcattcaaacatttataccatcttttatatttgcctaataattattttactggtcctgtgcatttcttcatatggatcaaagttaatgtctagtgctatttcacttaaggctgaagtctccatttaatttttctggtaggataggtattttgacaaattcagcttttgttggtttagaatgtcatttcttttttatttttgaagagtacttttgctgtttcaagatctatgggtagacagtcttacttctttttctttaaaatagtttgaatatgttatcttactgttttatggcttcaagagtttctgatgagaaatcagctgttagtctcattgaggattccttgtacctgatgggtttgtttttctcttcatattttgaagactggcttttgaaatttttactatgacgtctccatgtctttatgtgtatctcacttgagtgagtcaagttcatttgactcattttatatgtacatgtatgtttttcccttacattaaggaaattttaggcgtttgttcttcaaactgtttctgcccttctactgtgacttttatgaacatgttgatatgctgtgttcctcagttctctgaagctgtttttcttttttctttctgcttcacagaatggatctcctcaactgtcctgtattcaaattcgattaccttttcctgctagctcaaatagtgtgattaaatttttctagtgaatttttattatttatttctctgtatctttattgtctagtaattgatacatttttaaaaaatttaaattttaggtttaggagtacatgtgcaagtttgttatataggtagattgtgagtcatgttggtttggtgtacagattatttcattacccaggtaataagcatagtacctgataggtagttttttgatcctcactctcctcccaccttctaccttcaagtgctcccagttacaagagagaatgtatggcatttagtttactgttcctgcatcaatgtgcttaggattatggcctccagctctattcatgttgctgtaaagaacatgatttcattcttttttcatggctacatagtattccaaggtgaaaatgctccatattttctatgtccagtctaccagtgtgatagttaatattgagtgtcaacttgattggattgaaggatgcacagtattgttcctggatgtgtctctgtgaaggtgttgccaaaggagattaaaatttgagtcagtgaattgggagagacagattcaccctcaatctgggtgggcacaatctaatcagctgcacagtctcatcagctgctggtagaataaagcaagcagaagaatatagaaggactagactgtctgagtcttccagccttcatctttcacccatgctagatgcttcctgcccttgaacattggacttcaagctcttgtactcttggacttacaccagttgtttgcaaggggctctcaggccttcagcccacactgttggcttcccgacttttgaggttttgggactcagactagcttccttgctcctcagcttgcagaggaactattatgggacttcaccttgtgattgtgtgagtccatcctccttaataaactcccttttatatatacatctatcctattagtcctgtccttctgggaaaccctgactaatacaaccagtcctgggtacctgggttgattgtatgtctttgctcttgtgaataccacagtgatgaacattgaagtgcatgtgtcttttggtagaatgatttattttcttttgggtatataccagaaatgggattgttgggtgaaactgtagctctgttttaagttatttgagaaattctcagactgttttcctcagtgaccggactaatttacattcccaccaacagtgtttaaacattcccctttttcttcaggcttgccaggatctttctcttttttgcttttaataatagccattctgacgttgtgagatactatcttattgtggggttttttttgttgtcgtcgttgtttgtttttcgagacagagtcgcccagggtggagtgcagtggtgtgatctctgctcactgcagcctatgcctcccgggttcaagcgattctcctgccttagagtcccaagtagctgggactgcaggcgtgtgccaccatgcctggctactttttgtatttttagtacagatggggtttcaccatgttggccaggctggtctcgaactcgtgaccttgagtgatccaccaccatggcctcccactgctgggattacaggcatgagccaccgcatcgggcccttatggtggttttgatttgaatttctctgatgattagtgatactaagagcattttttcatatgtttgttgaccattctatatcttcttttgaaaagtgcctcttaatggggttgatttttgcttgttgatttatttaagtgccctatagattcaggatattaggcttctgtcaaatgcatagtttgtcaatgatctctgttcgccaatgatatggttctatacctagaaaatgccttctttaagaaaataaaattgtattttgtggatgtatcacattttccttatatatctgctttgggcatttgggttgcttctgcctcttgggcattatgaataatgctacagtgaatatggatatgcagatgtatgtttgagatcttgctttgaattactttggatatatacccaaaagtgggattcctggatcatatggtaattctattgttaatttttcaggaacctccatacatttttccacaatggctgtaccattttatgttcccatcaacagcatgcaaaggttccagtttctccacattgtcaccaacacttgctgttttttatttcactcttgttgcccaggctggagtgcaatggcactgtcttggttcactgcaacctccacctcctgagttcaagcgattctcctgcctcagtctccccgagtagctgggattacaggtgcctgccaccatgcccagctaatttttatatttttagtagagacagggtttcaccatgttggccaggctggtcttgaactcctgacctcaggtgatccacctgccttggcctcccaaagtgctgggattataggcctgagccaccacgcctggctcgttgtttttcaattgtatcttctaatggatgtgaggtgatacctcattatggttttgatttgcatttgtttagtaattagtgatactgagcatgttttcatatacctgttgtccatttgtttatcttctttggaaaaaaatctattcaattactttgccccttttttaaaattagggttttttgttgtaatctgagtttgttccctccctccctcactctctccctccctctcttccctccttccctccctccttccttccttccttccttccttccttccttccttccttccttccttccttccttcctttcttccttccttccctccctccctgtctccctccctgtctccctccatgtctccctccctgtctccctccctccctcccttcttttctcccttcctccctcccttcctccctccctttctcccttcctcccttccttgatcacatccacatccttccttccttcgtgctgtgttgctcagcatggagagcagtgccaaaatcatggctcactgcagcctcaactttccaggtgccagagagcctcccacctcgtgctcgtgggaccacaggcacatgccaacacgtctagctaattgttttttaatttttattttttggtagatatgggggtctcactgtgttgcacaggctggtttcaaactcataggctcaaggaatcttcaaaccatggcctctcaaagtgttgacattacaggcatgagttaccatgcccatcctgcatgtgaaagccttacgagatatgatatgcaaatatttctctcatttggtacgtttcctctttcattctgttgattgtttcccttcatgtacaaacattttaggtttgatgtagtcttgcttgtctgtttttgcttttgttggttatacttttagtgtcacattcaaaaacttattgacaaaaacaagaagggtttccatgtgttttcttctagttttacaatgtcaagatgtatctttaagtacttaatttattttgagttgatttttgtgtatgttgtaaggtaaggattcagtttactttttttttttaatttgcggatatccagtatgccaaatatgattagttagataaactgtgctctgagcacccatgtcaaagataaattgagtagagtacatggatttatttctgcattcttcattcttttccattagattatgtctgttttttgccagtattctagtattttgaattactatagctttgttatatacttggaaatcaagaagtgcctccacctttgtgtttcatgctgaatattgatttagctattttggttcttttgtggatccagataaattgtatgatttttttctctatttctggaaaaatgtgattgtgattttgataggaattatagtgaatcagtagataactttgggtagtatggatattttgacaatattaattagtcccagtggtggtgttgaggccgtgttgacctggaggcactggggtcagtgatagtgttgtcaagttggctgcaggatgggatggtgcctgggaggtcagtgcataaaaatcctatggatgtgatcaaggaaagggtgatggaaggtgatgtgtcctgtctgcttggtccttgtaggatcaggcaggacatcctgtaataaaaggagacattaccttcggatgtcctgagggcatggtgcaggcaccaggactgagtggaggggaggaagctcatgtcttgaggtcctttggctacatggggaagactgtctctgggcttgatgctgagttccagactgacgtgctggctgttgtgatggtgctctccagtgctggttgtggttggtttttggctaggtacacctcacctgggacagtggccaaagacagtgtcagttccagacatcagaagccccatgaggaagagcatgtgctcgcgccaggagtggtggctgttaggggagggacctcagacctatgtctgcatggcctgaggtcagagttcacatcctactgattgaagaccttgttcttgagctgtccggttgccacagggtcggacctggaggctgcagaccatcgtggccctttgcagtgttcggaaacatatgcgcaccccagggagggacacacacacacacacacacacacacacacacacacacacacacgcaaactcacaaacacaacacacagacagaaaatgacaaataaacacacacactcacacacacacacacaggagcccacagaaaaaagcaaatagacgcagaaacgggcacgtgcagtagttctggccacacatgttccctaggtatccacagaatggcatgggtattgtatattcataaagatggagatcagtcatggaggccaaggacaagtaggtgcactggttgaactacagtagagaatggcatggaagtggtgagcaatggacctgggcctgtttctcaagtgtgtatttgatttctttacaattccccggagaagttgtcatgggaggccagccgcctgctggcaaggaagatggttgattcttctgatcaatggaggccctgcagagtcctgtagtcactgtggcctggcatccatggtgcacccaatgctggtggatggcttaggacggtaagcattcctctgccccacgtgctgaatgagagtggcttttggatgtcctataccttcaaggagctgtttgtcagcagcgaatgacatggcaagttccactcctagagtggatggtctgtgcccattgctcagtggtgcagctctggcttccccagcatgctgaatgtctttaaggtcatcagctcgccccttcccagcctgtggtgtcaaatgtcttgccccttgtcaaatgtgcttggatcgatgatgagtcccctataaaaacattccttggaaaagctgaacaaaatgagtgagaactcataacgtcattctcatcggaactgaggtccagcatgttgcttcctctggggcctgtaggagtgagggacaacttccactgattcccataggttccaccacccagggcatccacagacaaaagtctcgtgtcacaggcacgttaggaacattccctctgtgtgaggtacatgggtgggagagtgatgggggattcggccgctctgtgatggcgtggtggccgtggaagcaggcagaaatgttgcaggcctaggggaagtggaaatgttgccagcacaggggtgtgtgctactggtaagctcccagaaggaagacccggacctcacagtggtcatctcagtgcagaagaccaggtgtctgttttcatgtcgaggagagcccaaggcccagacctcaggcagaccttggtgttgatttttgattagttgagaacaggggagtgccaaggtgttaggggagagtgcagagcaataggtgtcggggcaaacagtgaaagcctcttcagcctaccctgcagcattggtcaccaggagccctcctggaagggatttctttgcctcctgagctgtgagatgcctgtggtgcagtggcagaggcctaggtaggaaggtactccaggggaaaggtggtagagggatcacatggacatgagtgtcattagcaggcttgggctgtcattcaggggtgatgggcttcccatggatttttctggtggaagacaggttggccagcaggggtcttcgaggccaggtcctggggagcacgaggatcgagttggtgcccgtggccctgggtcacttccagtcttcccaggagagtaatgggctcctccattgtgcaaatcttcctataaatggtctcttggcccgccattattgggcggctccacctgctgcagcttgtatgagcaaatactgctctggatcctctttcctgcttggaaagcagcttcagtcctgaaggtccagagtgaatgtgccctgaccctggctctggcccaagtctgtgccgtaggtactcgtcacacttggagctatccatggaggtctgtgtgcattccaggcaacacgggtgcaatcccaggggtgctgccacagagtccttttacttgggatgcctcacacctctgcatgttggcaatatttaagtgttggagtccactacaccctaggggtgatgaactgttttggctcccttaaccggtttgaagtctcagcgcagccaggacagccatgccatgttgaagggcatgcagatggcttaggaatgttggaaaggatgggtggttctgagctcgcagctcactcactagctgcatgcatgtagacccagtggtggtgttcaggtagtgttgactttgaggcattgcggcgggtagtagtgcagtcaagttggctgcataatgggatgttgcctcagaggtcagtacaggatagccctgtgggtgtgtccaatgcaaggaaaatgaaaggcagtgtatcccatccgcctggtccttgggacatcggtaggggggacgtcccattggaaaagcagccattccgtttgtgtgtcgagagggcatagtgcaggcacatggactgagtggaggggaggaaggctgtgtcttgaggtcctttggctagattgggaagaccacctctggccttgacgccaagtttcaggctgatgtgctggccattgcaaaggcgccctccagcacaggttgtgattggttttccaccaggtacgcctcacctgagagggcggctagagacagtgtctgctcaggacatcagatgtcccgtgaggaggagtgtgtactcacaccaggggagttgactggtaggcgagccaccttgggcctatgtccgcatggtctccaggtcaaaattcacatcctactgattgaaggccttggtcttcagctgttgggttggcgtggtgtcaggccaggaggctgcagactatgactgcctgttgcagtgttgggaaacacacatgttaggaaacacatgtgcatgagggagacacacacacacacattcatacacacacacacacacacacagaggcatgccgagccacaggcaaatacatgcagcaatgggcgtatgtgaccacgtgcacttttaggtatccacagagtaacacatgtaagatatattcatggagatggaggtcagtcgtggaagccaaggaataacgggtgtgcaagttgcccaacgggaaagaatgggattgaagtgttgaccagtggacctgagcccatttctcaagcgtttatttgatttctttacacttctcagaggcagttgctgtgggaggtgtggtaactgctggaaggaagatgctcaattcttctgagcaacgaaggccacacggagtcctggattctgtgtggcctggcatccatggcgcactgtgtgctggcaggtggctcaggacggtaagcatttctctgcccagtatgctgaatgagggtgtctttcggatttccaagacccgcaaggagcagtttctcagctaaccactaatggcatggcgagttcctctcctagagtggatagtctgtgctcattgctcagtggcatcgctctagtggggccgaaggtctttaaggtcattggctcacccactgcccagcctgtggtgtcaaatatcctgccccttgccccttcaaatgtgcttggatcgatgatgagtccccaaaaaaaacattccttggaaaagctgaacaaaatgagtgaaaactcataccgtcattctcatcggaactgaggtccagcacgttgccttccccggggactgtaggagtgagggacaacttccactgattcccataggttccaccacccaaggcatccacagccaaagtctcccatcaaatgctcattaggaacattccctttttgtgaggtacacaggtaggagagtcctggggggaacggctgctctgtgatggcctggtggccatggaagcagacagaaatatcgcaggcctagggtagtgtgcgcctgatcttggcttggtgagctcctaggaagggagacgcggacctcgtggcaggcgtctctgagcagaggactgagtccttgttttcttgccggggagagcacaaggcccaggcctcaggcagatgttggtcctgatttttgattagctgaggacaagggagtgccaagggtgatgggggacagtgtataacaaagggtgttgtgacagagagccaaagcctctttggccctccacccagcatccagtcatggaggccccccagcagggatttcttcatcccctgagccgtgagatgcccctggtgctatggtggaagcctggactggaaggtactccacagaagaggtggtagggggcttatgtggacatgtgtgtcatcagcagtcttgggctgttgttcagcgttgatgggctttccatttatttctctagtggatgacaagttggccagcagaggtgtcagagggcaggttccagggaatacaagggtcagacttgtgctcctggcccttggtcacttctcgtcttcctgacagagtagtgggctccactgttgggcacatcttcctggaagtcgtctcttggcccgccattgccgagcggccacacctgctgcagctcgtgtgagcaaatatggctctggatcctctttcctgctttgaaagcagcttccatcctgaaggcgtccagagggtatgtgtcctggccctggccaggaactctgctgtgggcattggtcacacgtggctatccatggagatccgggtgcattccaggcaacattctaggggcctgccatggagagttcgttgacttgggatgcccctgcacctcccatgttggtgatgttccagtgttgcattctgctacaccctaagggtgatgaagcatttcagctcccttaaacagtttgatgtcacagtgcagccaggacagccatatcatgttgaggggcccacgactgcattaggaatgttggaagggattggtggttctgcagatcgcagctcattagtagctgtttacttgtagacctggtgatggtgctgaggcagtgttgacttgcaggagttgggatgggtggtaatgcagtcaagttggctgcatgatgggatgttgcctcagagttctgtgcagagaagccctgtgggtgtaaccagtgcaaggaccatggaaggcagtgtgtcctgtcaacctggtccttggggaagggacgtcctgttggaaaacagccattcccttcggttgtcctgaaggtgcagtgcgggcatgtggactgagtggaggaagcccgtgtcttgagatcctttggctaggttgggaagattgcctctggcttgatgccattttcagacctatgggttggtaattgtgaaggcgccctcacgtgctggttgtggttggttttccgccaagtgagcctcacctgggagtgcagccagagacagtgtcaggtcacaacatcagatgccccatgaggaggagcatgtgctcactccaggggtggtggctgttaggtgagggacctcaggcctatgtcctcctggcctgattttacatcctactgattgaagaccttggtcttgagccttcgggttgcaggggcttcaggtctggaggctgcagactatggcctcctgttgcggtgttgggaaacacatgtgcatgagggaaacacacatacactatcacacacacaaacaggcgctcacagccacaggcaaatatacgtagcaccacgtgcgtgtggtcgttccggccacacgtgcttcctaggtgtctagaaagtgacacagtcagatacatttataaagatggaggtccataatggaggccaaggagaagcgggcatgtgtgttgctctgtggaagagagtggcgttgaagtgaccagtgaacctgggcccatttctcaagcatgcatttgatttctttacacttctcaggggcagttatcatgggacacccgccatatgctggcaaggaagatggtcagttcttctgagccacaaaggcccccaacatcctggagttggtgttgcctagcatccacggtgcgccccctgctggtggatggctcaggatggtaagcattcctccgccgcacatgctgagtgggggtgggatttccaagacctgcaaggagctgtttctcagcaggccactgatggcatggcgagttccactcctaaagtgaacggtctgtgcccattgttcagtggtgcagctctggcttccccagcgtgcggagggtttttaaggtcatcggcttgcccactgcccagcctgtggtgtcaaatatcctgccccttcaaatgtgcttggatcgatgatgagtcccccataaaaacattccttggaaaagctgaacaaaatgagtgagaactcataccgtcgttctcatcggaactgaggtccagcacattgcctcccccggggactgtaggagcgagggacaacttccactggttcccagaggttctaccactcagggcgtccatggatgaaagtctcacatcacaggcacaatagaaatattccctctgtgtgaggtatacaagtaggagagtcatggggggattggctgctctgtgatgtcgtggcaactgtagaagtgggtggaaatgcagacctaggggagtgtgcggctggccttggcttggtgagctgccaggaagggagaccctgacctcctgatgggcctctctatgtggcggaccaggtcttttttttatgccaaggagagcacaaggcccagacctcagacagaccttggtcttgattttcagttatctgaggagaggggagtgccaaagtgatgggggacagtggagagcaatgggtgttgtggcagacagccaaagcctctttggccctccccccagtgttggttacaggggcccctggcagcaatttctttggctcctgagccatgagttatccatggtgtggtggctcagcctgggcaggacagtaccccagagaaaaggtggtagagggctcacatggacacgcgtgtcatcagtggtcttgggctgtcatttggcagtgatgggctttccatggatttctattgtggatgacaggttagccagtggggccttcaagggcagatccaaggagcatgagtgttgggctgtagcccgtggccctcggtcacttctggtcttcccggcagaatagtgggctccaccgttgtgcacatcttcctggaaatggtctcttggccctccattgctgagcagccccacatgctgcagctcttgtgagcaaataactgctttggatcttccgtcctgctttgaaagtggcttccatcctgaagactttcagagggaatgtgccctggccctggccctggctcggaactctcctgtgggattcggtcacacttggagctgtccatgggggtctgtgtgcagtccagacaatgcatatttaatcctaggtgccttccatagagagtcccttgatttgagttgcctctactcctctgcatgttggtgatactcaagtgttggatttagctacgccctaggtgtgatgaactgtttcaaccccgttagtctcagcgtagccaggatagtcatgccatgttgaagggcatgcagatggcttaggaaagttggaaaggattggtcattctgcggctcgtggctcacttagtagccatgtgcatgtagacctggtggtggttgtcagatgtcgttgagcaggtgttggggaggatggtcctgcatccaagttggctgcgtggtgggatgttgcgtcggaggtcggtgcaaggaaggcctttgagtgtgatcgatgcaaggatgatggaaggcactgtgtcctgtctgcctggtgtttggggcgttaggcagggatgtcccatgggaaaagcagccattccctttgggtgtcctgaggacatggtgcaggtacatggactgagtggaggagaggaagcccgtgtcttgaggtcatttgcctaggttgggcagactgcctgtggccttgatgctgagtttcagagtgacgtgctggccgttgcaaaggcgccctccagtgctggttgtgtttggttttgtgccaggtgtgcctttcctgggagtgctgccagagacagtgtctggtcacgacatcagatgccccgtgaggaggagcttatgctcaggctagggatggtggctgttatgtgagggcccttgggcctatgtctgcatggcctcgaggtcagagtttacatcctgctgattgaaggccttggtcttgaattgttgggttggtaggggctcaggtctggaggccgcagactatgactgcatgttgccatgttgggaaactcgtgttgggaaacacatgtgcatgagggagatacacacacacacacacacacacacacacagccactcagcaatgtgtgtgtgcgcggtcggtctggcgccacacacagctccaagctgtttgcagagtgccactggtaaggtacattcatggaaacagaggtcactcatggaggccaacagaagcaaggcgtgcaagttgccacgcatgaaagaatggcactgaagtagtgaccagtggacctgggcctgtttctcaagcgtacatttgatttctttatacttctcaggggcagttgccgtgggaggcccgctgcctgctggaaggaagatggtcagttcttctgaaccacaaaggccctgcagagtcctggagtctgtgtggcctggcttccagggttcacctcatgctggtggattgctcaggatggtaagcattcctctgccccatgtgctgagtgacggtgtcttttggatttccaagacccataatgagctgtttctcatgaggccactaatggcatggtgagttgcattccttgagcaaatggtctctgccttttgctcagtgccatggttctatcttccccagggtgccgaaggtctttaaggtcgtcagctcacctactgcccagcctgtggtgtcaaatgtcctgcctcttcaaatgtgtttggatcgatgatgagtccccccaaaaaaacattccttggaaaagctgaacaaaatgagtgaaaactcataccgtcgttctcagcggaactgaggtccagcgcgttgcctccagcagggactgttggagtgagggagagcttccactagtccctataggttccaccacccagggcatccgcaggtaaatgtctgccatcacacgcacattaggaacattccctttgcgtgagatacactgttaggagagtcacggagggattggatgctgtgtgatggcgtggcagctgtggaagtggacggaaaaatctcaggcctagaggagtgcgtggcactgatgagctcccaggaagggagacccggaccttgtgtcaagcttcctcgcacacaggaccgggtcctggttcccctactacagagagtatgaggtcccagcctcaggcagaccttggtcttgattttcagttagctgaggacaggggagtgccaagggtgatggggaagagtgcagagcaatgggtgttgtagcagatggccaaagcctcttcggcccttcccccagcgttggtcccagggtcaccccagcatggatttctttgcctcctgaaccgtgagatgcccatggtgtggtggtggagacctgggtaggacatattctctggtattccagagaaaaggtggtagggggctcacatggacaggtgtgccatcagtggtcttgggctctcatttggtggtgctgggctttccgtgtattcctctgatggatgacaggtcgggcagcaggggtcttcaagggcagttcccaggcgtgtgagggttgggctgctgcctgtggccctgggtcactccgatcttcctggcagagtaatgggctccaccgttgtgtacatcttcctgtaaatagtctcttggcccgccattgccaggcggccccacctgctgcagcttgtgtgagcaaatactgctcttgatcctttttcttgctttgaaagcagcatccgtcccaaaggcatccagagggaatgtgccctggcccaggcccaggaccctcccgtgggttccaatcatgcatggggctgtctgtggaggtccgtgtccattccgggcaatgcgtgtgcaatcccaggggtgttgccacggaaagtctcttgacttgggatgcctccacgcctctgcatgttggcaatgttccagtgttggattccgctactccctatgcatgatgaagcattttagctcccttagccagtttaaattcacagtgcagccaggacagccgtgccactttcaagggcacttggttggcttaggaaagttggaaaggattggtggttctacagttctcagttcacttagtagctgcatgcatgtagacctggtggtgctgatgcagtgttgacttgccagtgttggggtgggtagtagtgcagtcagattggctgcatgaggggttattgcttctgaggtcggtgcagggatgccctgtgggtgtgtccaattgaagaacgatgacaggcagtgtgtcctgtcaacctggtccttgggaattcaggtagggacgtcctgttggaaaagcagccattctctttgggtgtcctgagggaacggtgcgggcacatggactgagtggaggggaggaggcatgtatcttgaggtccttttgctaggttgctagtcctacctctggccttgatgccaagtttcagactgacatgctggactttgcaaaggcgccctctggagctggttgtggttggttttccgccaggtgcacctcacctaagagggtggccagagacagtgtcttgtcatgacatcagaagccccatgaggaagaggaggagcctgtgctcctgccagaggtggtggctgttaggtaagagacctgtgacctgtttccacatggcccggaggtcaaagttcacatccagtgatcgaaggccagggtcttgagccatcggattgctggggggatcaggtctggaggctgcaaactagaactgcccattgtggtgttgggacccacatgtgcattagggagacaaacatgcccatttaaactaacattctcacacatgcacacacccacacccacccatacacacacactctcatacactcacactcaaactcacactctctctttcacacacacacacacacacacacaggcacagacagccataggctaatagatgcagcgatgtgcacatggtgtggttctggccacatatgcttttaggtgtccacagagtgacgcaggtaaggtatattcatggagctggaggtcagtcatggaggccaaggagaagcaggtgtgtgagttgccctgtgggaaagaatggtgttgaagtgtccagtgaacctgggcctgtttctcaagcatgcatttgatttctttacacttctcagggacagttgccgtgggaggtccgctgcctgctgtcaaggaagatggtcgatgcttctgagaaacaggccctgcgggttcctggatttggtgtggcctggcatccacggtgcaccccgtgctggcgggtggcccaggacggtaagcatttttctgccccgtgtgctgagtgatggtgcctttagaatttctgagacctgtgagcaacagtttcttggcaggccattaatggcatggcgagttccattcccaaagtggatggtctgtgccggttgttcagtggcgcggctctggcttccctagggtgccaaagttctttaacgtcatcggcttgcccactgtctggcctgtgggtgtcaaatgtcccacctcttcaaatgtgcttggatcgatgatgagtcccccataaaaacattccttggaaaagctgaacaaaatgagtgagaactcataccgtcgttctcatcagaactgaggtccagcacgttgcctcccgtggggactgtaggagcgagggacaacttccactggttcccataggttccaccaccgaggacatccacaggccaaagtctcccatgaaatactcgttaggaacattccctctgtgtgaggtacatgggtgggagatttgtgggggcactggctgctctgtgatggcgtggcggccatggaagaggggagaaatgtcgtgggcctaggggagtgtgtggctggtctcagcttggtgagctttcaggaagggaggcctggacctcatgggtggcatctccatgcagaggacaaggtctcacttttgctaccaaggagagcacaaggtccaggcctcaggcagaccttgttcttgatttctggttagctgaggacagggaagtgccaagggtgatgagggagagtgtggagcaatgggtgccacggcagatggccaatggctcttcagccctcctgccaatgttggtcacagtgtccccccagcacggatttctttgcctcccgaaatgtaagatgcctgtggtttggtggtgaaggtgtaggcagggtggtattccagagaaaaggtgctagagggctctcgtggacatgagtgtgcattgggctttaatttggcagtgataggctttccatggatttctctggtggatgacaggtcagccagggtgggtctttgagggcatgtctctgggtgagtgagtgtgaggatggtgtccatggccctgggtcacttctgttgttcccagcagagtagggggctctactgttgtgcacatcttcctggaaatggtctcttggccttcgttgtcgggtggccccacctgctgctgctctcgtgagcaaatactgctctgtatcattcccgctttccatcccaaaagtgtccagagcgaatgtgccctgtccctggcctgggactctcctttgggctccagtcatgcatgaggctacccgtggagatctatgtgcattctgagcagtgtgtttgcaatcccaggggcattgccacagagagtcttgacttggcatgtctccatgtgactgtgtgctggcgatgttccagtgttggactccaaaagtccctaggcgtgataaagcatttcagctcccttagctggtttgaagtcacagagcaggcaggacagccatgccactttcaagggcatacagttggcacagaaaaattggaaaggattggtggtcgtacatcttgcagctcacttagtagctgcatgcatgtagaccgggtggtgttgatgcagtgttgacttgctggcattggggtgggtggtagcatggtcaagctggctgagtgatgggatattgtctcagaggttggtgcagggaaactctgtgggtgtgtctaatgcaaggataatgacaatgtcctgtctgcctggtctttggggggtcaggtggagatgtccttttggaaaggcagccattctctttgagtgtccagagggcatggtgcaggcacatggattgagtggagggaaggaagcgtgtgtcttgaggtcctttggctaggttgggaagactacctgtggccctgatgctgtttcagagtgatgtgctggccattgcaaaggcgccctccagtgctggttgtggttggttttccatcaggtgcacctcacctggtaaaggggccagagacagtgtctggtcatgacatcagatgctctgtgaggaggagcatgtgctcgtgccaggggtgctggctgttaggcaagggaccttggacctctttcctcatggccttgaggtcaaagttcacatcctattgattgaaggctggggtcttgagtctttggtttagtggggttggttccggtctggaggctgcagactatgactgcccgctggggtgttgggaaacacatgtgcattagggggacacacatccacacagagacacactcatgcacacatgtgtgcacagccacagacaaatagatgcagcaatgggtgtgtgcaatcgttaggccacacacacttataggtgtccatggagtgacacaggtaaggtatgaatgggtctttgaaggcatgtttctgggcgagtgagtgtcgggatggtgtccatggccctgggtcacttctggtcctcccagcagagtagtggtatgaatatggagatggaggtcagtcatagggtccaaggagaagcaggggtacgagttgccccgtgggaaagaatgacattgacgtggtgaccagtggacgtgggcctatttctcaagcgtgcatttgatttctttacacttttcaggggcagttgccttgagaggcccaccgcctgctggcatgacagatggtcagttcttccgagcagtggaatctccatggagtcgtggagtcggtgtggcctcgcatccacagtgcaccctgtgctggtggatggctcaggacagtaagcattcctctgccccgcatgatgagtgagggtgtctttagaatttctgagtcccacaaggaagtttttcagctggccattaagggcattgtcgaggcctttaaggtcatcagctcgcacactgcccagcctgcagtgtcaaatgtcctgcctctttgaatgtggttggatcgatgatgagtcctccaaaaaaaacattccttggaaaagctgaacaaaatgagtgaaaactcataccgtcattctcatcggaactgaggtccagcacattgcttcctctggggcctttactagtgagggacaacttccactagtccctataggttctaacacccatggcgttcacaggtgaaggtctcctgtcatattacaaacattccccccactcccctcccaaaaaaaggaacatttcctctgtgtcaggtacacaggtcagagagtcatagggtgactggctgctctgtgatggcatagtggccgtggaagtggatggaaatgtcgcaggcttaggggagtgtggggctggcctcggcttggtgagctcccaggaagggggacctggaaatcgctgcgggcatccttgcatagaggaccaggtacgtgttccagttctgctttcaaggagagcatgaggcccaggcctcagacagtccttggtcttgatctttggttagctgaggacaggggagtgccaagggtgataggggagagcgcacagcaatggatgttgtggcagacagctaaagcctttctgtccctcctttcacggtcagtcccagggggcccccagcacagacttttttcacctctcgagctgtgagattcctgtggtgttgtggccaagcctgggcaggaaggtaccccagagaaaaggttgtagagggctcacgtggacatgcatgccatcagtggtcttgggctgtcatttggtggtgatgggctttccagggatttctctggtggatgacaggttggccattgggggtcttcaagggcaggtcctagggagcatgagggtcgggctgatgcctgtggtcctgggtcactccattcttcctggcagagtagtagaagtgtccatcttcctggaaatggtctcttggcccgccattgccaggcggccccacctgctgcagctcgtgtgagcaaatactgctctggatcccatttcccgctttgaaagcagcttccatcccaaaggcgtccagagggaatgtgccctggccctggccctggcctgggactctccgatggggtccagtcacacttggcgtattcatggaggtccttgtgcattccaggcaacacatgtgcaataccaggggcactgccgtggagagtctcttgatttgggatgcctcctcgcctttgtgtgttggcgatgttccagtattggattctgctacatcctcagggcaatgaagcgtttcagctcacttagccggtttgacatcatagtgcagccaggacagccgtgccacattggcatggcacatagttgacttaggacagtcggaaagggttggtggttctatgtctcgcagctcacttcatagctgtttgcatgtaaacctggtgatggtgttgagatggtgttgacttgctgacgttggggtggttggtagtgcagttaagttggctgcatgatgggatgttgcctcagatgtcggtgcagcgaagccctgtaggtgtgtccaatgcaaggaaaatgaaaggtggtgtgtcctgtccaccttgtctttaggggttcaggcaggaatgtcctgttggaaaactagccattccctttgtgtgtcctgaaggcatggtgcgggcatgtgaactgattggaggaaggaagtgtgtgtcttgaggtcctttggctgggttcagaagactgtctctggccttgatgccgtgtgccgtgtttaagaccaacgtggtggccattgcaaaggtgccttccagtgcaagttttggttggtttggtgtcaggtgtgccttacctgggagagcggcgagagacagtgtctggtcacgacattatatgccccgtaaggaggactgtgtgcttgcaccgccaggggtgctggctgttagtcgagggacatcaggccaatgtctgtctgacccctaggtcaaaattcgcatcctactgattgaaggccttgggtctcgagccttttggttgcaggtgtggggatggtttccaggtctggaggctgccaactatgacaacccgttgtgctgttgggaaacatctgtgtgggggagacacatacacatagacacactcactctgacatacacacctacacatgcacaggcgtgcacagccacaggcagatagatgcagcaatgggtgtgtgctattgttgtggtcacatgtgcttcctaggtgtccacagagtgacatgggtcaggtatattcatgaagatggaggtctgtcatggagcccaaggagaagccggtgtgcaagtttccctgtgggaaagaatgggattgaagtggtgaccagtggacttgggcccgtttctcaagcatgcatttgatttctttacacttctcagcagcagttgtcatgagaggtctgccgcttgctggcaaggaagatggtcaattcttctgaccaacagaggctgccttgagtcctgatttggtgtggcctggcatctatggtgcacccaatgctggtgagtggctcagggtggtaagcattcctctgccctgtgtgcagaggtgtcttttgaattttgagacctgcaaagagctgtttctcagcaggccactaatggcatggcgagttccactcccagagctgattgtctgtgttcattgctcagtggtgtggctctgggttccccccaggatgctgaaggtgtttaaggtcatcagctctcccactgcccagcctgtggtgtcaaatgttctgcctcttcgaacgtgcttggatcgatgatgagtcccccataaaaacattccttggaaaagctgaacaaaatgagtgagaactcataccgtcgttctcatcagaactgaggtccagcacgttgcctcctctggggactgtaggagcgagggacaacttccactggttcccatgggttccaccacccagggcatttacagatgaaaatctcctatcacatgcatgtgaggaacatttcctctgtatgacatagacggatgggacagttgtggagggattggccactctgtgatgttgtggcagccacggaagcaggtggaagtgttttgacctagggttgtgtatggctggtctcggcttggtgagctcccaggaagggagacccgggcctcgcagcaggtgtctttatgtagaggaccaggtcacagttcccctgccaaggagagcatgaggctcaggcctcagatagaccttggtcttcattttccactagctgataatgggagttccaaggtgatggaggagagcacagagcaatgggtgtcaccgcagatggctaaagcctctttggccctccttccagcatcagtcacaggtgccccctggcatggatttctttgcatccctagccatgagatgaccatggtgcagtgaccaaggcttggccaggatggtaccccagagaaaaggtggtgaagggctcatgtggacatgtgtgtcatcagctgcattgggctgtcacttggtggtgatgggcttcccatggatttctctggtggatgacaggtcagccagggcgggtctttgagggcatgtctctgggcaagtgagtgtcgggatggtgtctgtggccctgggtcacttccggtcttctcagcagagtagtgggctccaccgttgtgcacacctttctggaaatggtctcttggcatgcattgttgggtggccttacctgctgcaactcatgtgagcaaataactgctctggatcctctttcccgcttggaaagcaatttccattctgaaggcatccagagggaatgtgccctggccctggcctgggattctccagtgggttccagtcatgcatggggctatccacggaggtctgtgtgcattccaggcaatgcgtatgcagtcccagcggcattgccacagagagtctctcgacttgggatgactctgcgtgttgacagtgttccagtgttggattccgctatgccctaggcgtggtgaagcatttcagctcccttaactggtttgaagtctcagcacggccaggacaggcatgtcacgctgaagggcacacagttggcttaggaaagctgaaaaggttggtagttctacggcttgcagttcacttagcagaaacgtgcttgtggaccccgtggtgttgagacagtgttgacttataggcactgtggtatgtagtagtgaggtcaagttggctgtgtgataggatgttgcctcagaggtcggtgcagggaagccctgtagatgtgtccagtgcaagaatgatgacaggcggtgtgtcctgtcaaccttgtccttagggggtcaagtggagatgtcctcttggaatagcagccattagctaggatgtcctgagggcacggtgtgggcatgtggactgagtggaggggaggaagcccgtgtcttgagattgtttggctaggttgggaagactgcctctggccttgacactgagtttcaaactgaggtgctggactttgcgatggtgccctccagtgctggttgtagttggttttccaccacatgtgcctcacctgagagggcagccagagagagtgtctggtcacaacatcagatgccctgtgaggaggagtgtgtgctcatgccaggcttggtggctgttaggcaagggacctcgggcccatgtccgcatggcctcaaggtcaaagttcacatcctactgattgaaggcctgggtcttgagcttttgggttgtgaggaggttcaggtctagaggctgcagactatgaccaccccttgtggtgttgggaaacatatgtgcatgagggagacacacatacacacacacacagacacactctctctctcacacacacacacacacacacacacaggcgtgcatagccacaggcaaatagattcagcaatgggcacatgctgtcgtttcggtcacacacgcttcctaggtctccacagagtgacacgggtcaggtatattcatggtaatggaagtcaatcatggaggccaaggaaaagtaggtgtgtgagttgccctgtaagcaagaatggcgttgaagaggtgaccagtggaccttggtctgtttcttaagcatgcatgtgatttctttacacttctaaggggcagttgccgtgggaggcctgccgtctgctgaaaggaagatggttgatgcttctgagcaatgaaggccccatggagtcctggattcggtgtggccttgcatccgtggtgcaccccgtgctggtggatggctcaggacggtaagcattcctctgccccgcatgatgactgagggtgtctttaggatttctgagacccacaaggagcagttcttcagcaggccattaagggcatggctgtggtctttaaagtcattggctcacccactgcccagcctgtggtgtcaaatgtcctgcctcttcaaatgtgcttggatcgatgatgagtcctccaaaaaaacattccttggaaaagctgaacaaaatgagtgagaactcataccgtcgttctcatcggaactgaggtccagcacatttgcctctgccggggactgtaggattgagggacaacttccactagttcccataggttccacctcccagggcatccacaggccaaagtctcccatcacacacaggttaggaacatttcctctgtgcgatgtagacgggtaagagagtcatgggcaaattgtctgctttgttatggtgtggcagccatggaagagtacagaaattttgcaggcctcaaggagtgtgtggctggcctcagcttggtgagctcccaggaagggagacccagatctcgcggcagatgtcactgcacacaggactgggtccgatttttttgccaaggagagcatgaggtgtgggcctcaggcagatctttgtcttgatttctggttacctgaggacaagggagtgccaagttgatggggaagagcaatgggtgtcccagcagatatccaaaggctctttggctctccttccagggttggtcacagggcctccctggcagggatttcttggcctcctgagctgtgagctgctcgtagtgcaatggcagaggcctgggcaggaaagtattccagagaaaaggtggtagagggctcacgtggacatgtgtgtcatcagtggtctggggctgtcatttggcagtgatgggcttcacatggatttctctggcagatgacagctcagccagcaggggtcattgagggcaggtcacagtgaacatgagggtcaggctggcacccacagcccttggtcacttctggtcttcacggcagagtagtgggctccactgttgtgcacatcttcctggaaatggtctcttggcccgccgttgccggatggccccacctgctgcagctcgtttgagcaaatagtgctctggatccactttcccacttggaaagcagcttccatcccgaaggcatccagagggaatgtgccttggctctggctctgccctgggcctctcccatgggctctagtcacacttggggctattcatgaaggtctgtgtgtattccagattccaggcaacatatgtgcaatcccaatggcattgccacagagaatcttttgacttgggatgcctccgtgccactgtatgatggcgatattcaagtgctggattctgctccatcctggggtgatgaagcgtttcagttcccttagccagtttgaagtcacagtgcagccaggacagccatgccacattgacgggcttgtggttggcttaggaaagttggaaaggattggtggttctacagctagcagctcacttagtagccacatgtatctacacctggtgctggtgttgaggtggtgttgacttgcaggcattgttgtgggtgggaatgcggtcaagctgactgcacgatgggacattgcctctgaggtcagtgcagggaagccctgtgaggtgaccagtgcaaggacaatgttaggtggtgtgtcttgtccactcggcttttggggcatcaggcgtggacgtcctgttggagaagcagccattctcttcaggcatcctgagggcacgtgtgcgtacgtggactgagtggagtggaggaagctgtttcttgaggtcgtttggctaggttgggaagaccacctctggctttgacgtcatgtatcagtgcaacattctgagcattgggcaggtgccttccagcacaggttttggttggttttccgccagatgtgccttacctgggagtgcagcaagagacagtgtctggtcccgacatcagaggccctgtgaggagtagcctgtattcgcgccaggggtgtggtggctgttacacgagggacatcaggcctatttccacgtggccttgagatcagagtgcacatcctactgattgaaggtcttgaacctttgatttgttggggggatcaggtctggaggctgcagactataaccgcccattgcagtgggaatctcacacacacacacacacacacacacacacacacgtgtgcacagccacaggcaaatactcgcagcaatgggcacatgaggttgttccaggcacacacacttcctatgtgtccacagagtgacagaggtaagatacattcatggagatggagatcaatcatggaggccaaggagaagcaggcatgcaagttgccccacaggtaagaatgggtttgaagtgaccagtggacctgggcccatttctcaagcatgcatttggtttctttacacttctcaggggcagttgccatgggaggcgcaggcctgctggaaggaagatggtcgattctcccaagcaacaaaggccacgtagagtcctggtttcagtgtggcctggtatccacagtgcaccccgtgctggtgggtggctcaggacggtaagcattcctctgcccttcgtgctgagtgagggtgtctttgggattcccaagacccacaatgaacagtttttcagtaggccactaatggcatgctgagttcctctcctagagtggatggtctgtaccttttgctcagtggcacagctctgggttccccagggtgccgaacatgtttaaggtcatcggctcacccactgcccagcctatgatgtcaaacatcctgcgtctttgaatgtgcttggatcgatgatgagtcccccataaaaacattccttggaaaagctgaacaaaatgagtgagaactcataccgtcgttctcatcggaactgaggtccagcacattgcctccactttggcttattgtggttcacgggtaactgtcatattacatggtacttcactacccaggcactggcattcaatttttgtggtcgttttgaccatagtaaaattctttatcataaatgtatttgagaatcatacttgggtagcccatgaatttttttagtgttactcttcttggtgtcaagttggtttcacccttaatgctaggttttggatttttgttgcatgattgatttttagccaggttctggtcaccaatcacagcctttcaccaacattcatggagaaagtttccttgttttttttatatgttgaggaagtacatatttcctgaatgtttttgcttttgttccaatgttgggctgactggcatgtcatctcttatcttatcttgaactgagtagtggtacaagtttttggctttcagcatccagggcaccaagtcttttgtacacaaattgcaagtattgaagccatggtgttgattgggatgctctacgcccatactctttagtggcatgacgccctcccagggtacccggaatccacatgtgcaactctgtatatgtgtttctgtgaacacagatatgtgaagccatagataagcagatttcatatgtaccacaggagtctatatgacatagccttcctgacctatgtacctgtctgtctttctgaagcacactcatttcctctgcaccttcctggtgtcattggcatggaaggaaggcccttgtccaagaaggatggtcttcgtcttgtgtgatctttgagatgccatgaggcccctggatacaaatggtgtgggctcctttggaggcttttggatttctcctgaatgtaagtgatttcttctgaaagcattctgattttcctcacttgcagggacaaagactatgtgtaggttgatgatgacttacatatatacgttttttttttttttttggaaaggtgaacaaaatgagtgaaaactcagtaccatcatcctcatctaactgaggtccagcacgcttctccatcagggcctagatttagggggccaacatctgtttgttatcatggtgtgcaccaaggcttaggatgtagttgtctttcagtgaaactgagtagctgagtattttgtactcccctggctgagagatacgtttgttgaacgacttacctgtgagaaggtggggtagcatcctgccagtgtgcaggagaaggtaaacctgcaggtgccacaggaaggcggtatccagttgcccacctctgcatggctgggtctgtccttgattcatacctcttgggttcgtcaccccccagaagaagacaatttattccacatgaggagacagcacggtgccattcctgagcacttcttcaactgtctttcatctgtggccggggacatgggacttcttatggtgtttgggtagcatcaagggctggccatcttgaagccagtggtgatgctgatttgctctctggaaaggagcctggagaagctctctacagtgaacttgtacatctataagtagaattccaaatttcatggcccaagaagggtagtggctgtgggaaggggagaggtctgtgtgtgcctttacctggcatcattccatgtgggtcgtggagtgatgactgtgaggctctttaagacattgcagggtgcccaaggtccatttcgtgatatcctcaggatggtttgcttgggagagcctgatgtcatttgcctctgaaccgctcagacatcttgatgcagttggggtttataagagtgtgtcattccccacatcgtggtgacttctacttggaaatgtgacctgcgaaggtctccttgcttatatacctcagcgtctcctgatattagggtattttcaaattcctcctaattcttcacagcagtcttctttgtgaaatagtcgttgtgtggtaggacagggctaccatccacaggccaatgatggataggtgttggactctgatgttatgttcacaggcaagtgccttaagatcttgttttcttagctgcagcaccttagaaatcttgtaggattcagaatgcctggtgctcttctgggtccctgatctgtacctgtgtagtgcacatggaggttgatttgtgatgtttctggatgggaagagtgtgaaggacccaaggggtaaaaatgcctcaaggccaaaggaaagttaacctttgcataggaagaggtttcccctccaaactctcctcactgaagtatcaccatagcctttgtcttctctgatggccaggagaagggtttttgagttggaggtgttataagagtggtgttgagagtgttcttcatgcttagtgctctctagttgatggtgccttcaaaattcatgcctgcctcctaccttcatgtttgggcaaacccatgcatgtgtgcagaaagaaggggagcccatgggaggtagatacagattactccacaacaggacaaatgacatgacccttgccacctatgcacctcactgcctttctcaagcacactgttttgcttctgcacttcttaggtggcgttggtatggaaggaaggccagtgaccgcaagggatgactttgatcttgggagatttttggagatggcaaagtgcttctaaacatgtttggcatggtctccttcaggctggtggatacctcaggatggtaagtattggttttccaaaggcacctaatgttccatgtttgcaggtatgaggactgtgcatggatcaatgatgacttccatacgtgggttccttggaaagttgaacaaaatgagtgaaaactttatactgtcatcctcttcaaactgaggtccagcacactgcttcaacaggggctagagatggaggtctacctctcattcattgacgtgggttgcaccaaggggtctgtccaggcttaggatggggttctcttttggcaaggggtagccccaggggagtgggagctcccatgcacaggagattcctggtgtgaaggacatctcttagtgaggccagggtagcacacacaccatcttcaagactaggtgaatgtgcaggtgacacaaaggacttaggctctgtgtcccccagtttgttcttgagtcttagttcttggttctctcatcatcgggaggaaggcaggtccttctcgttgggaagagaggacaagcctacacttttgcctcatttttggctcatttttatccttgtgtatgtacatagatttctggtcacctgcatgcttcacatccaggccagagtgcctctgttgtaccctctgtgttatgaagacatacagttggcctcctgccctaagctggggctgataggcaacgagtctctggcttatctcaaacctggtgtaggtcaaaggcttcctcgttaggggtgcaggtccccgaggcttttatgatcaactttgcaggtgtgcacgggtgtttaaagggatgctcaacatcagttctctctagtgggattatgtactccatgggctcccaggatccagacgtgcatccctgtgtctatgcagttctgcgtccataaacaggtgaagccagagatgggcagattgcagatgtactgcagggggccagatggcatggccctcataacctctgcacatgtctgcctttctcaaacatgcccatgtttcatctgtacctcccaggtggcgttggcatggaaggaaggactgtgtctgtgagggatgatcatcctctcatgtgatccttggagatgccaggaagccccttgacacatgtggcatgggctccttcagaggcttttggatccgtcgtgaatgtaagcaagcccttcccaaagccctgattttcctcatttgcagaaacaaagattgtgcctggatcaatgatgacttccatatatacattccttggaaagctgaataaaatgaatgaaaactctataccatcatcctcattgaactgaggtcccagcatgctgctacattggagggcaaggagagggggccaacatctgtttgttgacatggtctacaccttggcttaggatgtggtcctctttgggcaaatgcaagcgtctgggctttttggacttctgtagctgagagacagcttggttgaaggaatttcctctgagaaggtggggtaagcacactgccagcctgcagaacttgaagctgcagatggcacaggaagcagtagccagtagtctctttgtgcatgactgtgtgtgtccttgattcatagctttttggtttgtcgcctccccgcttgcacaggaataccattgctttcctttggggagagagcatgtcattcctggacacttgttcggcttactttcattctcagtcgaggatgtgggagttcccatggtacttgggtagcatcaggggcaggcagccatgaggtgggtggtgagctgatttgctttctgcagaggagcccagggagggtatccacattgaactcgtatgtccataggaggaaacccaagtcctttggtccctgcagtgtactggtggtgggaaggggagagggctgtgcatgcatgtaccaagcgacattccatgtgggtcgtggagcaatgactatgagcctcttttgggagttgtagggtgcccatgctccatttcatgatgaccttggggtgctgggatgggaatgagattgcaagtccctgtgttcctgccacttcgcagactgacttggtttgagagatctgtgttcaggaacccctgtgggatgcttgtctgtgttaggcatttgagcagatattggcccagggtttctacccttccatggttgtacatactgctggaagggcttgttgctccctctgtattgatgaggggaagttttgcccaggagagcctgatgccatttgcttctgaactgctcaggcacttcaatgcagttgaggttaagagtgtgtcacttcccatgtcgtggtagcatctactcagaaaagtgacccgtcaaggtctctgcacttaaattctccattatcttatgatgttaggttattttcaaattcctcctaattcttcacaacagtcctctttgtgaaacagtcatgaagttgtatgagggctgtcatccacaggccagtgatggagagttttgtactctgtggccatgttcacaggcaagtggcttaagacgtatcgtgttctcagggacagcaccatagaagccctgtaggattcagcatgtctgatgcttttctggttccctgagctgcacctgtgaggaaggccagaggtggaggttgatgtgtgattgaatgtgtttctcaatgcaaagtgtgtggaaggagcttcaaggccgaaggaaagttgttctttgtgctggaacactttttccctgcagctctccccattgaaatatcctcatggctgttgtcttctctgatggccaagagaatggcttttgagtcaggggtggtgaaagtgtggtattgagagaattcttcgcgcttagtgttctctagtttgatggtgcccttgaaatgcatgcctgccttataccttcatgcctgggtatatctgtgcataagtccccaaagagaggtcacccatgggaggtagatatagaatacagcatggcaggaggaatggcatggcccttgcaaactgtgtacctgcctgcctttctcaagcacacctgtttttcctctgcacttcccaggtggcatgggcatgcaaagaaagacagaggctgcaagggataaacttcatcttgggagatccctggagatggcagggaacccatggacacatgtggcatgggctcctttgggtgccggtggatcccttcatacggtatgtgttcatttctcaaaagaccctaatgttcttcctttacaggaatgaatactgtgcatggaccaatgatgacttccatacatgcattccttggaaagctgaacaaaatgagtgggaactctgtactatcatcttagttgaactgaggtccaccgggggctatagagggacaactgtcattttttttgatgcccgttgcatgaagcattcttccaggcttaggaagggattccgtttgggtgaaggagagtcacaggggagttgaggctatgtgcacaggacttctgtctacaaggctggggtagcacacatgcagtccgtgggactaggtgaatgtgcaggttgctcagggagagttaacctgtagcctgcctctgggtggccaagattgtccttgactcctggctctgggttcccacaacccctggaggaagacaagtaattgtgcttgggaagagagaacaaggccatacttttgcctttctttttttcattcttagtttgagaacagtggagttccaatcacctggcatagctttcatgttgtgttccatgcattgtgagtacatgcatatggcaggaacacacaggttcccactgcaagctgagcctgataggcaaggagtctctagcttaaccccagcccagtgtacgtcaatggcttcctcattaaaattgcatggccctgtagcttttgtgagtgacattataggtatcgatgtaagggtgttgagagggatgctcaatgtcagtgctctttagtgtgctgatgcactactacaagggcacctgagcccttgtccatgcatttctgtgtccaaaatcaggtaaagccagagttgggtatcaaccagatacactgcaggggatcagaggacatggcctttgtgtactgcacatctgtcagattttctcaagcacacccgtgtttcctcttcacctcccacgtggaagtgatgaattggccaggaccatgttggtgagggacaatcatcatctcatgttaacctcagagaagccaggaagctcctggacacacatggtgtaggcttccttggaggctgttggatctctcctgaatgtaagcaattccttcccagtgcaccctgattttcctcatttgcagaaacaaagattgtgtgtggatcgatgatgacttccatatatacattccttggaaagctgaacaaaatgagtgaaaactctataccgtcattctcgtcgaactgaggtccagcacattactccaacaggggctagacagagagggccaacattgattcgttgacatgggtggcaccaaggggaccatccaggcttaggatggggtttctttgggtgaatggtagacacaggggagtaggatctcccatgcacaggacataccttgtttgaaggacttctgtgtcctagggctggataactcatgtgctgtctggaggactaggtgaatggcagattgcatgggaagagttaactggtagcctgcctctgatggccaagtttgtccttgagtccaagctctgggtaccgaagtcccccagaggaagacagatccttctggttgcggggagagcaaaaggctacacctttgccattagttggctcattttatccttagctgaggatgttggagttgtgtttacccggcatagcctctgtgcctatgtgcccatgttgtgtactgtgcattgtgaggatgtatatttggcatgaacaggcaggcttcctctccaaactggggctgatagacagcgaggctctgggttatcccaaaccagatacaggtcaatggcttcctctttaggggtgcagggccttgattattttgtgactggcattgcaggtgttgaaacaagggtattgagaaggatgctcaacatcagtgctctttagcgggatgatgcattctgagggctgccatccccaagatgagcatacttgtgtccataaatttctgggttcacgaacaagggaagccagagacaggcatattccagataaaccacagggggaagatagcatggtcctcgtgacctgtgcacccgtctgcctttctgaagcatgcttctttatcctctgcacttcgcaggtagtgttggtgtaaaaggcaaacccgtgtcatgagggatggtcatcatcttgtgtgatccttggagatggcaggaagccctggacatacatggtgtgggggctcctccagaggctgttgggatcctcctggatgtaagtgattccatttcaaagcaccctgagtttcctcatttgcagggatggagattgtgtgtggatcgatgatgacttccatatatacattccttggaaagctgaacaaaatgagtgaaaactctataccgtcatcctcgtcaaactgaggtccagcacactgctccatcaggggctcgagagagaggaacaacatccatttgttgacacagactgcaccaaggcttggggtggggtctttttctggcagaggagagtagctgggaattttggacgtttgtaactaagagacagcttggttgaaggcagccaggtgtgtcgtcaatttgtaccttgggtcccttgtcctccagaggaagactattgcttccacatggggagacagcacaaggtcattcccagacacctctttcactcactttcatccttgtcaagggacgtaggacttcccatggtgtttggatagcatcaggggcaggcaggcagtcttcaggaggatggcgatgctgatttgctttctgcagaggagcccagagagggtatccacactgaacttgtatgtccataggaggaaacccaaaccgcatggtcccagaagggtcctggtggttagaaggggagaaagctgcacatgcatttaccacacagtcttctgtctgggttgtggagagatgactgtgagcctcttttgggtgttatagggtgcatacggtttattttatgatgatcttgggatgctgggatgggaatgtaattgcgaatccatgtgttcccgcaactccacagacttgacttggtttggcaggtttgtgttcaggccctctgtggaatgcttgtcttcattaagaatttgagatggggctgggcacggtggctcacaccttctgggtgcttgagctgcacctgtgagaaagaccccgaggtggaggctgaattgtgattgagcatgtttcttgaatgtgaagtgtgttgatggatgcttgcagtaaaaatgcttcaaggctaaaggaaaattgccctatgcacaggaagagttttttttttcccaaaactctccccattcaaatatctctatggtctctgtcttctctgatggccaagggaagggcttttgagtcggggcaccaaatgagtggtgtccagagttcttcacatttagtgctctgaagcttgctggtgccctcaaaatgtatgtgtgcctcaaaccttcatgcatgggtactcccatgcacacatcctgaaatgggtatcccatgggaagtagcgatagggtatcccacagggggttgaatggcatggcccttgtgacctatgtgtttgcctgcctttctcaagcacacccgtgttgcctctgtacttcctaggtggtgtgggcatggaaggaaggccagtggagacaatggatgatcttgttcttagcagatcactggatgtggcagggagtcctaggacatgtgtggtgtgggcttcttcaggtgctggtaagtatctattccccaaaaccccctaatgttactcctttgtgggcatgaagactgtgcatggatcgatgatgactttcatacatgcattccttggaaagctgaacaaaatgagtgaaaactctataccgtcatcctcgtcgaactgaggtccagcacattgctcttacaggggctggagtgagggccaagtttcatttgttgctgcaggttgcaccaaggggtttgttcagttgtaggaggggctccctttctgcaaggggtagtcacagggttgtgagatctctcataaataggaaattgttttagggacttctctctgcaaggtaacacacacacaccgtctgtaggactatgtgaatgtgaaggtgacatgggaagacttagcctgtagcctgcctctggtggccatatttgtccttgagtcttagctctgggttccatcattcccttgaggaaagacaggtgtttgtgcttgggaagagagcacaaagccccacctttgctgttttttccactcattttcatcattgttcaaggacattgcagttccggttttatccataaccagggaagccagagacaggcagatagcagatatgccatagggggccagatgacacggccctcatgacctgtgaatgtgtctgcttttttgaagcacactcgtatttccgctgcacttcccaggtggtgttggcatgaggaaaggaggtatcttcgagggacaatcttcttcttgtgcgatccttggagatgccatgaggcccctggacacatgtggtgtgggctcctttggaggctgttgtatcccttctgaatgtaagtgtccactttccaaagtcctgattttcctcatttttgggcatgaataatgtgcatggatcgatgatgacttccatatatacattccttggaaagctgaacaaaatgagtgaaaactctataccgtcatcctcgtcgaactgaggtccagcacactgttcatcaggggctagagagagagacaacatccatttgttgacacaggctgcatcaatgcttgggatgggatcgtctttgggtgaagtggagtagctgggcattttggacttctgtggctgagagacagcttggttgaagctcttccctctgtgtggctatgtgtgttatcgattcataccccttggctcctgcactccccagaggaagacagttactgctgcatggggacacagcacaatgttgttcccaggcacttcttcggctcacttttatcctaagtcggggacatgggagttcctgtggtgtatgggtatcatcaagggcaggcagtcgtgaggagggtggcaatactgatttgctttctgcagagaagcccagagagggtatccacgttgaattgtatgtccataggagggggaaacccaagtcccgtggcccctgaagcatcctggcagtggaaggggagagggccgtgcatgcgtgtaccacacagccttctgtctgggtcacagagcgacgactgtgagcctctttcgggcattgtagggtgcccatagtccatttcatgatgacctcagggtgctgggatgggaatgtaattgtaggtccacgtgctcctgcatctctgcagactgacttggtttggaaggtctgtgttgaggaacctctgtgggatacttttccttggtgcatttgaggtgtctgataatgagtgtgtgggtttctgtatcctggtgacttctactcagaaatgtgacccagcaaggtctctgtgcttaaataccttagtggcttgtgatgttaggttattttcaaattcctcctaattgtgtgtgacaattcacacaagtctttgtgaaattgtccttgaattgtatgacagggctagtgtctgtaggccagtgatggataagttttggactccacagccatgttcacagccaagtggcttaagatgtatggtgttcttagtcatagtgccttggaagccctgtaggattcagcatgtcttgtgctcttctgggtccccgagctgtacctttgaggaaaacccagaggtggaggttgatttgtgattgagcatgtttctcagtgggaagagtgtcaaaggagcctggggtgaaagtacttcaggaccaaaggaaaattgcccttcactcaagaagaggctttccttgaacctgtccccactgaaatatcctcatgggcttcatcttctctgatggccaaaagcaggacttttgattcagaggtggcaaatgaatggtgttgagagagtttgttatgcttggtgctctgtagctggaaggagccctcaaaattattgtgtgcatgatagcttcatgcctgcttacacccatgcacatgtcccagtaagaggggctgcctgtgggagatacatacacgatacaccacagtgggatgaattgtatggcccttgcaatgtgtgtacctgcctgctgttgtcaaacacacctgtttttcctctgaactttccaggtggcgtgggcatagaaggaaggccagtggccacgagggacaatcttggtcttgggagatcctggaaatgatagggagtcccttgatatgtgtggcatgggctccttcaggtgctagtggattccttaggatggtaagtgtccatttctcagaagctccagatattcctcctctgcagggacaaagactgtgcctggatcgatgatgacttccttatatacattccttggaaagctgaacaaaatgagtgaaaactctataccgtcatcctcgtcgaactgaggtccagcacattgctcttacaggggctagagagagagggacaaatttcatttgatgatgcccattgcaccaaggggttctgtccaggcttaggatggggtctcgtttgggcaaaggagaatggcaggggagtggaggctatgtacacaggagattccttgtttgaaggactctatttgtgaggccagggtaccacacatgctgtccgcaggagtaggtgaatgtgcagttgcccaggaagagttagcctgtagcctgcctctgcatggcagtttgtccttgggtcctggctctggatttccatgttccttggaggaggataggtgattttgcttgagaagacagcacagtaccatacttttgttgtttttctgctcatttcatcgtccattgaggacaatgaagttgtggtcagcaggcatagctttcaggccagcgtgcccatgttgtgtcccatgcattgtgagcacatgcatgtggcatgaacacataggctgccactccaagctgagtctgataggcaatgagactctggcttatcctgatcccggtgtagatcaaagtcttcccagtaggattgcatggccccgaggctattgtgagctgcattgcaggtgtggaagcaagggtgttgagagggatgctcaacattagtgctctttagcgagatgatgcactataagggcaccctgaacccagacgtgcatccctatgtacgtgcatttctgtgtccataaatagttgaagccagacagccagattccagatgtatcgcagggggctggatgacatggcccttgtcacctgtgtacctgtctgcctttctgaagcacgcttgtgtttcctctacacctcccaggtagcattggcatggaaggcaggcccatgttggtgagggacaattgttatcttgtgtgagccgcagggataccaggaaacccctggacacaaatggcaaaggcttctttggaagttgttggatcccttctgcatgtaagcagttctttcccagagcgctctgattttcctcatttgcagggacaaacactgtgcgtggatcgatgatgacttccatatatacattccttggaaagctgaacaaaatgagtgaaaactctataccgtcatcctcgtcgaactgaggtccagcacattactccatcaggggctagacagagagggccaacattcgtttgttgatatgggttgcatcaaggggtccatccaggcttaggatggggtccctttgggcaattggaagtcacagggaagtgggagctcccatgcacaggaaattccttatttgaaggacttctttctccctgggcgggataactcacctactgtctgaaggactaggtgaatggcaggtggcatggaaagagtttgtgggtagtctgcctctggtggccaagtttgttcttgagtccaagctctggattcccagaggaagacagatcccctggttgcggggagagcacaagcctacactattctcacttgttagcttgttttgtccttggcggaggacgttgtatttccaggcacccagcatagcctctttgccgcatttccatgtcatatcccatatgttatgaggatttgtgtattgcatgatcaggcaggcttctgctccaagctggggctgtcaggcaaggagtctctgggttattccaaacctgatttaggtcagtggcttcctctttcaggattcatggccccaaggcttttgtgagcaccattgcaggtgttgaagcaacgatgttgagagggatgcccaacatcagtgctctttagcaggatggtgcacctcgagggcccctggccctgggacgagcatctgcgtgtccatgcatttctgtgtccatgaacaggcgaggccatagacaggcaaatagcagatgtgtcacaggggactggataacatggccctcgtgacgtgtgcaacctgtctgcctttctgaagcacgcctgtgtttcctctgcacttcacaggtggtgttggcatgaaaggcaggcttgtatcatgaggaatgattgtcatcttgtctgattcttggagatggcaggaagcccctggaaacacatggtgtggactctttcacaggctgttgaaaccctcctgaatgtaagtgatttcattccaaagcaccctgagtttcctcatttgcagggatgaaacctgtgtgtggatcgatgatgacttccatatatacattccttggaaagctgaacaaaatgagtgaaaactctatactgtcatcctcgtcgaactgaggtccagcacattactccaacaggggctagacagagaaggccaacatccgtttgttgacatgggttatatcaaggcgtctgttcaggcttagaatgtggtctcttatgggtgatgggggtcacaggagagtggtggctcccatgtataggaaatttcttgtttgaaggactgtcagtgagggtgggtaacacatgcattgtctgcaggactaggtgaatgtccatgtggcctagcaagagttagctggtagcccgcctctggttgccaatttgttcttgagtccttgttctgggttctcaggtcccacggaggaaaacagatctgtgtggttgagaggtgggtacaaggccgcatctttgtcatttgttggctaactttgtccttggttgaggacattagagttttggtcaccaggcatagcctatgtgcctttgtgcccgtgttgtatcccacgtgttttgaggacatgtattttgcacgtaaaggtgagctcctgctccaagctggttctgataccaaaggagtccctggcttatcctaaactcatggtaggttaaagccttcctccttaggggttcagggccgcaaggcttttgtgagtggcattgcaggcgttgaagcagtgatgttgagagggatggtcaatgtcagtgctctttagcaggatggtgtactgcaggggcccccagccccgagacgagcatccctgcatccatgcatttctgcctccatgaacaggggaggccagagacaggcagatagtagataaattgcaggggactggatgacatggccctcgtgacctgtgcacctgtctgtctttctgaagcacgcctgtgttaactctgcacctcccaggtagcactggcatggagggcaggcacatgttggtgagggacaattgttaccttgtgtgagctgcggagataccaggaagcccctggacacaaatggcaaaggctccttcggaagttgttggatcccttctgaatgtaagcacttctttcccagagcactctgagtttcctcatttgcagggacaaatactgtgcgtggatcgatgatgacttccacatatacattccttggaaagctgaacaaaatgagtgaaaactctataccgtcatcctcgtcgaactgaggtccagcacattactccaacaggggctagacagagagggccaacatctgttttttgacatgggttataccaaggcatccgttcaggcttaggatggggtcttttatgggtgatgggggtcacaggagagtggtggctcccatgtataggaaatttcttgtttgaaggactgtcagtgagggtgggtaacacatgcattgtctgcaggactaggtgaatgtccatgtggcctagcaagagttagctggtagcccgcctctggttgccaatttgttcttgagtccttgttctgagttcctggaaggaaacagatttgtctggttgggaggagaatacaaggccacatctttgtcgtttgttggctaactttgtccttggttgaggacattagagttttggtcaccaggcatagcctatgtgcctgtgtgcccgtgttgtatcccatgtgtttgggggacatgtacattgcatgaactagtgagctcctgctcattgcttctgatacccaaggagtccctggcttatcctaaacccaatataggttaaagcctttctcattaggggcccagggtcccaaggcttttgtgagtatcattgtaggtattgaagcaacgatgttgagaaggatgctgaacatgctctttagtgggatgacgtactctgaaggctcctgacccccagatgagcatccttgtgtccgttaacttctgtgtttatgaacaggtgaggccagagacaggcagacagcagatgtattgcagggagctggatgacatggcccttggaacctgtgcacatgcctgcctttctgatgcacgtccatgttttctctgcacctccccggtggtgttggtataaaaagcaggcttacatcagcaagggatgattgtcgtctcatgcgatcctgggagatggcagaagtcccgggacacatggagtgtgggctctttcggaggctgttggatccctcctgaatgtaagtgattccttcttaaagcatgctgattttcctcatttgcaggggcaaggactggatcgatgatgacttccatatgtacattccttggaaagctgaacaaaatgagtgaaaactctataccgtcatcctcgtcgaactgaggtccagcatactgctcatcaggggctagagagagggacaacatccgtttgttgacaagggctgtgtcaacacttgggatggggtcgtctttgggtgaagtggagtagctgggcattttggacttctgtggctgagagacagcttagttgaagcacttccctctgcgcagctatgtgtgtccttgattcaaactccttggctcctgcactccccagaggaagacagtggcttctgcatggggacaccacacaatgttgttcctgtgcacttctttggttcactttcaccctcatttggggacgtggcagttcccatggtgtttaggtagcattgagggcaggcagtcctcaggaggatgttgatgctgatttgctttctgcagaggagccagagagggtatccatgttgaacttgtatatccataggaggaaaccagtcccatggcccctgaagggtcctggcagtgggaaggggagaggtctgcatgtgcatgtactggacagcatattccatgtgggtcatggagtgatgactgtgggcctctttcgggcattgtagcaggcccccatttcatttcatgatgacctcggggtgctgggacaggaatgtgattgcgggtccacgtgcttctgcaactcctcagactgacttggtttggaaggtctgtgttcaggaccctctgtgagatgcttgtctccattaggcatttgagcttatatcggcccagggtttctacctatcgtaggttgtgcatactttgcctctgaaccactcaggcacctcgatgcagtcaacgtgcccgattataagagtgtgacttcccatatcctggtgatctctactcggaaacatggtccaggaaggtctctgtgcttaaataccttagtagctcgtgatgttaggttattttctaattcctcctaattcttcccaggagtcttctttgtgaaatagtcatcttgttgtaggacagggctggtatccacaggcagtgatgcataggttttgcactgcgcggccatgttcaaaggcaagtgccttaaaatgtatggtgttctcagccacagtgccttagaagccatgtgggattcagtgtgtctggtggtcctctgagctgcacctgtgaggaagacgctgaggtagaggttaagttgttattgaacgtttttctcaatctgaaaagtgttcaagcagcccagggtgaaaagtcttcaagactgaaggaaaattgccttttgtactggaagagtttttccccaaaactctcctcatttaaatagccctgtggcttgtgtcttctctgatgaccaagaggagggcttttgagtcagtgatggcaaatgagtggttttgagagagttcttacacttagggctctgtagcttgatggtgccttcaaaattaacacgtgcctgctatcttcattcctgggtagacccatacacccatcccaaaaggggagtagcctgtgggaagcacatatgggatataccacagtgagtcgagtggaatggcccttttgacatgtgtacctgcctcccgttcttaagcacacccgtttttcctctgcacttcccaggtgttgtggccatggaagtaaggccagtggctacgagggacagtcttcatcttgggagatccctagagagggcagggagccccttgacatgtggaatgtgatctctgttgggtgctggtggatcccacaggttggtaaatgtccattttccaaaagcccctgatgttccttctttgcagggataaagactgtgcatggatcgatgatgacctcaatacatgcattccttggaaagctgaacaaaatgagtgaaaactctataccgtcgtcctcgtcaaactgaggtccagcacgtggctccaactggagctggagagagagagacaacttccattggttgatgtgggttgcactaagccatccatccaggcttaggatggggtccactttggatcaaagggagtcacagggcagtaggtgctcctgtgcagaggagattccttgtgtgaaggacttctctttgtgaggctgggtagcacgcacaatgtctgcaggactgggtgaatgtgcaggtggcacagaagagttagccggtaacccgcctctgtgtggccaggtttgtccttgagtgctggctctgggttcccttgttccccagaggtagatagctccttgtggttgggaagagagcccaaggccacatctttgttgttctttggctcattttttttcatggctgaggactttttagtgcccatggtgttttcgtagcagcagtggaagtcagttgtgaggaggttggtgatgcttattttctttctggagagtaccctgtagatcggctccatttatgatttgtgtgtctccagggagaaactgaaatcccatggctggtgatggatactccaggtgggaatgagaaagcgccatacatgtgttgacttggtaccctaagatggggatggtccgccacatttgcgcgtctgttttgcatggtgtgtactgcacatcacaaatgccatgttggccttagggtgctgggaatggaatatgatctgatgtctacatgggagggcctttcagcagattgcttttgtttcctgacagtctttgctccatccccagtcacacgtgtttttctccagggaacattttattggagtatatcaggtcgatatcagaaaaaaaaatgttgtggttatcccaacattaagtgtggtgatgtaacagcagtgtggatggtagctcaagtgaacagtggcaaaaccaaaatatattggtttacgtaagtgaccctattctctcctatgtttgaagtctggtatgcatctctttctgcaataatctcagtgatctggaaactttcaggaggtcttttttagatattttatgtccttgtggttgtactcatactccctgcagtgctaagtctgagtcattctgctatcctagtgctactggaatttctattgttttgggggcactgtctggtcattgtggatacctctcttggggccctttaataagaagtatgttagaggtcggttttggggcagtgttgacctcctgcctaaggtcaaaggcagttttcttcctaaatcttattgcaggattcactgcctgggggttgtgtgacagggagagcacaaaattagggtatcccatgtggacttgtgtccagtatcaaggcagtgttggataattttctatatccacaaggctcccactggactctttatgtccagcagacattcacaggccaacttttctcttacacagggggcctcattcctgccatgtgtagcttccatggaaccatccttcaggttttaagtgcaaggatttctctcaagagtttaatttgtttctttaagacaccgttttcttttctataaattctgctttctgtggtttgtagcacagatgaaattgccaggtcatattctacatttctgcccaatcttggattagtgagcctttgaaatatgttccttgatcactggcaatggttcttggaataccagaacttagttacaagcattgcagacctacagaggtttgttgttatttttaactgcatgaagcagtgggtttgtttgtatcttgtcactcacggctgtcagcaaaacttaggtgttgctaaaccagaccacacccatgaattatagtgcctctggttccttctgtagtagcctgtgggaagtagatacaggatgcaccacaagggaatgaatggcatggcccttgagacctgtgtacctgcttgcctttctcaagcacacctgttttgcctctaattcctaggtggtctggcatggaagaaggccagaggctgcgatggatcatctttgtcttgggagattcctggagatggtggggagcccctgggcacgtgcagcatatgtggcgtgggcttcttcaggtgctggtggatccctcaggatggtaaatgtccattttccaaaatcttctgatattccatctttgtaggtacaaagactgtgcatggatcgatgatgacttttatacatgcattccttggaaagctgaacaaaatgagtgaaaactctataccgtcatcttcgttgaactgaggtccagcacattgctccaacagtgggtagatagagagggaaaacttccatttgttgacgcaggttccattgaggggtttgtccaggcttaggatggggtcccctttgggcaaagggagtcacaggggagtgcggcctcctgtgcacaggagattccttgtgtgaaggatttacctctgtgagagcagggtagcacacataactatgcaggagcaggtgaatgtgcaggtggcacaggaagagttagatggcagcctgtctctgcacagcgaggtttgacttgtcctagctctgcattccctcatcccttagaggaagttggtttcttcagaagacttaaatttgtggaattcagtagaatattatccacataatgttcccagtgaatgctaggcatatcacccaagatggccaggcctctggccataaaccatagtaaatagtagggtgtgcatatatccattagggagaacctgaaaggtccttttttggccctccaaggtgaatgcctgcaaaagcaagcgaagcacgctatctgcctgcatgagccccatgtacctggcgtggcctgtgctcctcaccgtgtgtcccacttctgctgccccttcgccttgccaggtggagtctgactgattttttgccactgctgccaccacaggccacctggagccccagccagtttgaggaaagtggctctgcttgattttccttttttctttttttttcctctttttttctccatttctgacttcagcaggtgggacttggagcttctgcttctgcagccacagaagactccccagtttggagggctgtggttgtgggctccctaagcatctctctgcagagcctctttgttttccattttacccaccatgtcaataatttaacacagtggcggaggagttcatgtctcttcctatttgtcattactcttctaactttcacagctgtactcggctactggtcagaataagagaaaaagcagtggaaccaggaggatcctacaagaaatattccatttcacttttgtttgtgcatataccttttctgtttaaatgtggacttcgatttgatatgcttccagtgcagacacagatcccatatgtaagagagtatggagttgcatagaaagaagacttgtcattttcctgtactgttggtgttctaatctgtcttcgtggtttttgcctcttctggctttagaagatacaccaacatggttttgcaacatagcctcttcttattttagtaagggaccaaatgtgcatgtcagtaacaggtgttaccttgaattgggatcagtgcttgtgtgactatattcagtgatgtcattttctgtcacactcaagtcacaaaatatttaaccacttatttttttatctctggaggaataatccaaaagattgtactggtaaagccagaacaatttccaattatgctaattatttgtataatacttagttggctttatctgtggtttgttggcttattttcctgtagcttttcaaggtttttctatgagttctgttaaagagtctgaaaatggagcgtagaagacatgcttcgatttccaggatggttgtgttttccagagaggcggaggtaaaccactggcgcagccctgcctcccacagataattccgggtgcagtgtttcatatctagacttggacttctatcctaccatacttctttgtgtgcaggtatttttggggataaaatccttgttttcagctgtatagatgtcttgcacatactcttttgatggtttgatttatccattgtgttcagcacgtttcagtgagcaagatatgggatttaatttccaatataaaatccatgactgctggccgggcgcagtggcttatgcctgtaatcccagcactttgggaggccatggtgggcagatcacgaggtcaggagttcaagatcatcctggccaacatggcaaaaccccatctctactaaaaatacaaaaattacccatgcgtggtgttgtgtgcctatagtcccagttactcaggaggctgaggcaagagaatcccctgatcctgggaggtggaggttgcagtgagctaagatcatgtcactgtattccagcctgggcgatagagactctggctcaaaaaaaaaaaaaaaaagaatgttataattattttcagcctcatgtctccgtgtcacacacaggtccatgaagctgtgttctttttttttttttttttttttttttcagagtattttctttcttgtccagattagctaaattggattgttctatgctaaattcacttaatcactactctattatttttgaattttttagttctgtttttttcacttggttctttttttaaaaaaacttctactacctttctgagacttctacttttttacttttttcaagaagctttataattacttgctaaagcatttttaccatgactgtttttaacttcttcagataaccacaacatttggttaatcttgaggttggcttggttaactgtcttttctcatcctgcttatgattttccttctaattgtgatttttccggttcttgatagatgggtgatgttttagtttatcctgcatttttttttcctttttaagttagaggaatctgaatctattcaaatgttttattttagcaggcatgtgccctgtttaggtttaatttgaatgtcctgtcctacttttgtaggccatgttttcgcaggcagtcttgctatcagagctgaggggatgctgttttgatcacttagtttatctgatgttgctgggcctccaactggtgctgactggtacttcctgagatggcgaaggtttttctgtactctgagatgccgtgtatctctatgtaaggggaggagactctggaccacaggaatgaagagaacatcttaggtcaggcagctcaatcatatgcgataacctgggtcaaccagccagtagcctcatgaagtatgggagggaattctccagtgtcagcattcaaagacatcatgagtttttacttctcattttcttttaagtgaaataatcgcatggaaattaaagaataaatatatgaaatatatgaaacttatatgaaatataagaatgtgagaaggcctacagcgtggggatccccaggctatttgaacaatgaatgtctgtgttacacatctttgctcactttttctctatttttgtagttcattgtggaaccagcacagattttcatacgaaagttatttctttttaacctcaaaaagtgacagaatggagtgtatcatgaaaaagtctgacatcaaaacctcaaaatgtgatattggtaagcattttgtcctgagaataccagcatttcctcttaggggatcatgacactgcagtgaccatgtgaccctggctgtgctagtcagcctgggctgttcattgactgtgatgctggtctccatgtgattgactagtgtgggtcagtgcctccaaaggtgacagctgtgtgctcagtgtctgccacatatctcaggctcaaggtcccttttataaatgtgcctggatcgatgatgactttaaaatggatctcatcggaatctgaacaaaatgagtgaccaaatcacttctgtgccacttctgtgagctgaggtccagcacaggggccatgccagacaaacacatggagggtgttttgtttggtcagcactggtactatgaaacggcctgtggaattagacaactaaccagctcacatacagtacaggaaattactggacagttaacctaccaatatatggttgggggtaagacggagacttttcaaatgcttggctggtagcatctgtacactacagtgaccagacactgggagccagcacaggagttataggatttacaggaaattattgtgtgaacccacaagccattcagacatttgtgtgagcgcccagaatattctggttgatggtttgttgcttgatggcaaagagatgtcagcattcaaagacatcatgagtttttacttctccttttcttttaagtgaaataattgcatggaaattaaagaataaatatcttatatgaaatatatgaaacatatgaaatataagatatttatttatatcatataagatataaatatctcatatgaaatcttgtagtatattttcatttgattgccaacccagtcactaggactgaaacagttgtttattttttgttttcccatcaaccaagcaagctatttaatacatgtttcagtgctggtttcaactacatgttgcagcaaacatttttagaagtgatatttcaaattcttggattttcacatggatttcattgtctactttcatatgtcctccatgtgtgaccactgtattaattaaaagttgtaataaatgattttgaaaggtatgtgctggaggaacttcgggacaaatgttttagaaaacattatttccataaaatttggatcaaagatgtgagcataattgttcttgttatacagatggtccaatgagtgtctaatgtgaattcttataactgtttataacaaagtagtccatgaagcaaattttgtttcacaactttcctaatttcccctgtactctgtagattgggtgagatagaattccatggaatttcattgccaaaccagtgaagtgctaattttgacatttgtaccagctaacgtagctgtgaagaaacacaccaatacacttctaaggtaacattcaatttttagtgaatttatttttgtgagttatttttattcttttaagtaatcaagaatttatgttcacaaggaattggttaatactaacagtttcagacattaatgttctgatgagctgaggcatcaatctccttttgataaaggttttgttcttttctctactttgaataacatatgaaatgtccaacagcagttctaagttagtgtatattccatatatgttaatagtgaaacatcctgtcttatgcaaggctaaaaattgtccgtgtatacttctcagatttgtatacatactctcttcctacaggacagcatagaccaagatctaggtttcatatggatgaatttattcttccctttgaggcaagacaagaaggaaagaaagtattgggaataatgctgccctcccatcctcaagggccagtgggaactctaatattggtaagccttttgtcctgaaaataccagcatttcctcttagggaatcataacactctgctaaccgtgagactctggctatgctagtccgccatgggctggtcattgactgtgatcctggtctccatgattgaatagtgtgggtcagtgtgtcccagagtgacagatgtgctcagtgtctgccacatatctcagactcaaggtcccttttataaatgtgcctggatcgatgatgactataaaaaaaatggatctcatcggaatctgaacaaaatgagtgaccaaatcatttctgtgccacttctgtgagctgaggtccagcactgggaccatgccaggcaaacatgaggagggagtttacagggactagggtattggaaaactaacctacccatatatattagagcaaatgaattgttctcagttctgtaaatatccagctgtggtttgacatagcaactctctttgtatttgcttggcagcatttatagaaacagctggtagaccctggggaaccagggcatagtgagattcatgggacgttatttcacctactcttgagccattcacacatttgagctcgcagaattatctggtcaatgagcagtctcttgagggtaatgagatggtcaacatccaaatccaaagatactaatgagattttacttttttttttgagatggagtctcattctgttgcccaggctggagtgcagtggcataatctcggctcactgcaacctccacctcctgggttcaagagattctcccgccccagcatcctgagtagctgggattacaggcgcccgccaccacccctggctaatttttgtgtttgtagtagagatggagtttcaccatattggccaagctggtctcgaactcccaacctcaggtgatccagccactgcagcctctcaaagtgttgggattacaggcatgagccgccgtgcccggccttactttttattttcaattaagtgaaacaattacatggaaattgaaaaaaaaaaaaggtactctaagtagactactctagtgtattttaattttcttgccaattcagccactaggattgtgtcacttgtttttttgattttagtttttcgtatcaaaaagcaaaccactgtttatatttgagtgctggtttcaactgtatgctgcctcaaataaacttagattatattacaaattcttttttacatagatttcattggctatattcatatatcctcaaaggtttccattgtgtttgaagaggtatcctaattgtaataaatgcttttgattggggatgccagggaagctttgagactaatgtctcagattttttttaaaaaagtttatattctatagtgatcaaagatgtaagaataatttttcttgtcattcattggatagtccagtgagtgtctactgtgaattcttatattcacttgtaactaaacattccatttggcaaatttcgtttcataacttccctaatttcctctacactttgtagattgggtgagatacaattccatggaattttaccactgaaccagtggagggctaattttgtcatttgtaccagttaactaacttgggaggaaacagaacaacacactcctgaggtagtatccaatttttagtaaatttatttttattatttttcaaactgtcagtgatttggtttggtgaacaataggttaatacagacaatgttaggaattattaatctgatgcgctatctgaagcatcagtttcctttatttttaagatttttttcttctctgtagtttggataatatttaaaacatttccaagagttataaattagtatattttctatgctgattaataatgaaaccttttgtcttatacagatttttaaaaaatggacgtgtgcgtgcatgtgtatatatataaatatatatatatataaaatctcttctcacaagatgatgcagactaaaactgcattttacattttatatggctaagtttattgtttccttgtgttgtaatatgatggaaagtaatgggaataattctgcttcctgtccttagggaccagtaggaattttcccatgataagcattttgtccttaaaatactgacatcctgttaagagatcatgacactccaatgaccatgagaccctggctatgctagtcagccagggggctgaccattgacagtgatgctggtctccatgattaaatagtgtgggtcagcatgtcccagggtgacagaaagctgtgtgatcagtgtctgtcacatatctcagactcagggttcctttttaaaatgtgcctggatcgatgatgacttaaagatttatctaatttaaatctgaacaaaatgagtgaccaaaacacttctgtaccacttctgtgagctgaggtccagcacagagaccactccagtcaaacatgtgttgcctggagttgcaactagttggtcagttagaagcaaccacagggactggggtatttgaaaaccacttgagtgcatttattagaggaaacgaattttacatttgtgtataaaaattcaattgtagggtaaaatggaaactctgagagtttggttggcggcatctatataccatagaaacagagcctgggaagcagaacagtgagacccaagagaaatgttcctgcctatacttggtctgttctcacatttgcctgagctactgattgatcttttgagggtgatgagatggtcaaaatccaaggatatgatgagtttttacttctcattttctttttttttttattatactttaagttttggggtacatatgcagaacgtgcaggtttgttacattggtatacacgtgccatggtggtttgctgcacccatcaacccatcatctacattaggtatttctcctaatgctatccctcccctagcccctgaccccccaacaggccctggtgtgtgatgttccctccctgtgtccatgtgttctcattgttcacctcccacttatgagtgagaacatgtggtgtttggttttctgttcttgtgttagtttgctgaaaatgatggtttccagtttcgttcatgtccctgcaaaggacatgaactcatgcttttttatggctgcatagtattccatggtgtacatgtgccacattttctttatccagtctatcattgatggacatttgggttggttccaagtctttgctattgtgaatagtgccgtaataaacatatgtgtgcatgtgtctttatagtagcatgatttataatcctttagatatatacccagtaatgggattgctgaatcaaatggtatttccagttctagatcctagaggaattgccacactgtcttccacaacggttgaactaatttacactcccaccaacagtgtaaaagtgttcctatttctccacatcctctccagcatttgttgtttcctgactttttttaatgatcgccattctaactggcatgagatggtatctcattgtggttttgatacacatttctgtaatgaccagtgatgatgagccttttttcatgtttgttggctgcataaatgtcttcttttgttttacttctcattttcttaaagtgaaacaatttcatgtggtatcttccaagtatattttaatcagttgccaacccagctgctaagattgaactgtttcttttgttcttctcttgtttttttctattaatttagcaaacaattttatatatagtttgctatccttctccatggggcctgcatcttcagattcaactagccatggattgaaaatacttgacaaaaaattgtatggtttcatctgtactgaacatgtacagtctttttctctctttttctctttctttcttttttttttttttgagacagagtttcactctgtcacccaggctggagtgcagtggcacgatctcagctcactacaacctctgtcccccgggttcaagtgattctcctacctcagcctcctgaatagctaggattacaggcgcccaccactgtgccaggctaatttttgtgtttttagtagagatggggtttcaccatgttggccgggctggtctcgaactcctgaccttaagtgatctgcctgcatcagcctcccaaagtgctgggattacaagcatgagccaccatgcccagccaagtacagactttttctttggttattattccctaaaacagtacagtataacaactatttacgcagcatttacattgtattcagcatcatgagtaatctagaaatgatttcctgcatataggaggatgtacataggttctatgccaatagtgcacagtgctcgctgtgtttaaagaaatatcctaggtatagaataaataattttgaagtcagtgtgttgagaaaacactgacatggatagaaaatattctgtctagaatagaaaaaacaatagaatagaaaaagttctatctgtatcagtctgatcaaagatgtgagcataattattcttgtcatacatatagtctaatgaatgtctaaagtgaattcttataactgcttgtaacaaaatatttcatttggcaaatgttatttcacaactttcctaattgcccatgtactttgtagattggttttcacagaattccatggactttaactgctgaaccaatgatgcactgattttgtcacttgtaccagctaacgcatctgggaggcaacaaaacaatactctcctgaggtaacatcgaatttttagtaaattcatttttgtgtgttgtttttattatttttttaagtaattgagaatttcattaggtgtgcaaggagtcacttaatacaaatagtattaggcattcaatactctcatgagatatctgagccttcagtttcttttattttaacattttacatttttctcaactttaacatcagaaacatcctataagtgtaataaaattcttatactttacatatagttacatagtaaatcctcctgtcttatttaagtttgaaaaatgaacatgtatacttctcattcccatgtatataatctcttcccacagaatgaggtggaccaagaaactgggcttcatacggatgaatttatttttttccctgtgtggagacataaaggaaaagtatagtgaataattccgcctcccacccacaagtccccatgggaattctcacatgttaaaaagcattttgtcctgaaaataacaacaatttttcttagggaatcaggacactccaatgacagtgagactctggctatgccaggcagccatgggctggtcattgtgctgctggtctccatgattgaatagtgtgggtcattggtgacagatagctatgtgctcagtgtctgccacatatctcaggttcaaagtcccttttataaatgtgcctggatggatgacgacttaaaaatgaatctcgttggaatctgagcaaaacgagtgagcaaaccacttctgtgcagttctgtgaactgaggtcaagcacagggaccatgccaggcaaacacgtgcagagagttcagtttggtcagcaactggtaccaaaatggcctgtggtattggaaaacaaacccactcacatagcttacagcacatgaattgtacagaggtctgtatgtgtttgtatatatttatatatgtttgtgtacatatatctttggggattatatggcatttctttcagtgtttggctggcagtgtccatactctcatagtaaacagaattacacaagagtagagggaacagtaggaaatggttttgcctaccctagagtcttttatacatgtttttaggtgctataatcttgtgtgtgaggtcagtctctcaggttcattagatggacagtgtaaaaggtattatgaggttttacatattatttatctattaagtaaaagaaatatatggaaattgaagagtagcttttatctattaaagaaaagaatgtatggaaattgaagggtactttctatttgtggaaagtcttaacattttaatttccttattgatcttgtcacagaagttggaatttaagttttgcctgtcactcaaagagaagctttttagacatttgattaagggattctagtagatgctatagtaaacatttctaattgtaaaatgattaaatttgcaattcatagagttttatgtggatttcattgcctgatattcattatttttattagtgggtttcatagatgtttaaagggagatcctagttttattgtgtgatactaagggaggccttttggtcttagaaaactgactttcagtactacccatttccagggagtgagcataatttttattctcataccacatgggcaagtgaatatctatggtttatttcttataactcgtcattagtaattatgaaagtaagaaagttgacaaatgaaactcttttaattatgagggtttcatttgtcgacttcctacttcctcagtgtgctttgtgtattggaggtaatactggaattgcatggaattcctactgctgctccagtaacctgctgattttgtcacgtgtaccagattcgttgtctggcaatgagaacaatacacttcagaggtaatattgcaatttttagtaagtgcatttttcctgggttcgttctattattttattttagcaagtaagattataattggtttttcaagcagtctgttaatccaaatggtgtgaggccctaataatctggttagtcatctgaagtttctgtgttctttgtacagtatttttatacttcctctgttttcaaataacattaggataccctactagcaaaataatttagtatattttatatacttgtgcatagtaagcctgttgtatatgtacactatttgcatggttggcaaattacatttgcactttttatttttctataattttttcctattttcaaaggttaatgtggaccaaaaactagatttcatataaaagagtttattccttctacttgaggtgtgacatgaaggaaagtaatggaaataattctgccctcccattctcaagggccagggggaattcaaatattggtaagcattttgtcttgaaagcaccaacattcttcttagggggtcatgacactccaatgacaatgagaccctggctgtgcttgtcagtcatgagactggtcactggctgtgatgctggtctttgtaattgaatactgtgggttggcaagtccccaggtgacagaaagatcagtgttcagtgtctgccacatatctcaggcttaaggtcccttttataagtgtgcctggatcgatgatgacttaaaaaaatggaaaccttggaaatctgaacaaaatgagtgaccaagacacttctgtgagctgaggtccagcacagggaccataccaggcaaacccgtggagggcgttcagtttggtcaggaactggtaccaaaacgaacccacttgcatatgttagagcagatgaattgtacagaggcctatatatcttcgggaattacatgacaatgatttaagtgcatggctgacagccttcaaacacctagtaatcaggctttggggtaccagcgtcagaggagtgaacactgtagaaatggctgtgccagcactcgagtcattcacactattttcgtagacgccacaacattcttagtgagtatcagcatgtataggtatattatgtagtcaattagaaagaaattatcagtctttgcttgctatttattctttcactaaaagaaatatgtgaaaattgaagagtgggttgtattcatgggattatcttattacatgctggaatttgcttcctaactcagtctcaaggattagaacagcatttgtttttctttttcctgtcactcagggagcaattttctaagcattagatgatagattaaattagatgcttcattaaacattttaatgtgaaataatgaaatttctaattctagggattttagatggatattgttggctaataggaatattccttcattgagtctttgtatattttaagagagattctaattttagtaatactcggggcctttggccttcgagaccaaaatcttggaaacattgattttctgtacttaccctgttccaagcaacaagcagattttttagttatgtggatagtcaagtgactatggctaattaattacaaactgttgtcaggaatcattcagttgggaaggttttgtttcaaaactcctgtaatgtcccctgtgccttgcagaacggaagtgattttggaattgcatggaattctcactgccatcccaaagaaatgctgatcttgtcactcttacctgtttcattccctgggggcagaacaaaaggacgcactccaaaggtaacatccaagtttgaataaatttactttttatggcttattttgtaattttttctgtagtcaagtagataatcagttttgtgaatgatctgttaataacagtatgagacattaattatctggtgaatcatccaaggctttcattatcctttatttccaattttttttgcgttctccttttcagtaatatcaaaaacatcctagtagagttatgttagtatatttgatattaatatacataacaaacgctcccttcttgtgcatgtttgacaaatggacatatatacttaccatcttcccatatttgtactgttttcacagatcggcatgaaccaagaactgggtttcatataaaatattttattctgtcctcttgagatgtgacatgagaaaagtattgagaatacttctatcacctcatcttcaagaatccgtaggaattctcccatggtaagcattttgtcctgaaaatactggcattcctcttaggagatcgtgacactccaatgaccatgagaccctggccatgctagtcagccattggccagtcattgactgtgatgccagtctccataattgaatgaatagtgtgggtcagtgtaccccaagctgatggaaagctgtgtgctcagtgtctgtcacatatcccaggcttaaggtaccttttataaatgtacctggattgacgatgactttaaaaaaaaaaaatctcattgaaatctgaaaaaaatgagtgaccaaaccacttctgtgagctgaggtccagcacacatgataggcaaacgtggagggatgtggatggtcagtgcccacagggactggggtatttgaaagctaatctgcctgcgtatgttagaggaaatgaattggacagtcatctataaatatcgtattttttaataaaatggctattcctttggtgcttggctggtagcatccatccactggtagtaaatagaccctggaaaaccagcacatatgtagtgagaccccatgagacatgattgtgcctacctttgagccatccataagttatctgggacatgacagtcttttgagtgagagcagtttactaaggtcatttagatcatcagttccaaagatggtgtggatcttatcgattatttttttaggcagaggtaatatctggaaaattaagagtgatttctaaccatgagaatattttagtttgtttaaatttgcttgctaacccagtaccaagaattcagaccttttttctgtctgtataaagcaatattctagacatttgagtgattcaagtagatgttgtgagatgattacatttccagtccttggaatgttatgtggattttattggctaatcttcatatttcatcagtggattttcctatgcatgttaagggagatccttgttaattgatgtctaggtggactttacggttaacctgaacaggtcttggaaaaaggactttaaacattctcctgttctgtggaataagtatacttttttctggacatacaccttgtcagtgagtatgtatcataattcctcataacttcttatcaggaaacattcgatgtagaagatttctttctcaacttctctaattgcccctgtggtttgcaggttccatgtgatactagagttgcatagatttttaacctttacgccaatgaagatctgaggcaaacattgccccttttttagaagtttgcatttgtcactgataactgtaataattgatcttgttgaaaagcctgggaaatgaagatctgatatgtcacttttaccggcttcctcaactgaaaaagaatacaatgaaacacgctgaggtaacatctaatttttgatatcttttttcctgggttattactgttttaagtatttaggaatttaatgggtgctatatggagtcagttaattcagatactataagaccttaatctggtgagtcatctgaggcttctgtttgttcttttccagaatttttgtgctttctcagtcttgctgatgatctttctatgggcctgaagcgtggagagtgccagagaggctgatcctcagcagtgtggcagaggaaagttgggtgcgactaaggggtatgcggtgcccacatgccactgggtcctcagcagtaccacctggtgagcgtcactcttgagagctgagagtaggtgggaagcagctcatggtgagagggttcagaggccgcctttccctctctgcgcactgcccagttcttctagtcacatgtcccgggacagtaccatacctgtgtgtgtcctgcctgcattgctgtgaccacttttagtggaatcaggtgcagtgcagctctgcagcttctgcaaattgccacgctcccactctcaagcaggttgagtgctacgagtgatttttagaccatttgtttattcccttatcatggctttttgtgacttcttcctccccagtccgttgggtcacctttaaaggtaaagtaatcctgaggtggttgaatttacggaaatgctatgcattattgtgaatgggatgttcaccgggccaacatcttcttggaactttgagcaaactgatagtctggttgcacatttgatttgtctggcagtaaatgttggacagtatttggactgatggaagctagagacaaacacattgactattgttgaataacactggaaacatcttaggagagcagtacattagctaatttaataggtacataaactgaatcccactgtcttgtgcttgacggaccagcagacacatatgcttgtatcgttctcatgtttctacatgtttaccctattcccacaggtcaacaaagacaaggcacctagccccacatgaaactttattcctttcccttttgagatgtgacatgaaagaaaataacagaaatgatttttccatcccatcctcagggaccagtgggaatgaattttaccatcccaccctcaagggccaggtcaggtcgctaagcattttgtcactaaaatattgcccttttttagggattatgtaatactctataaggcactgtctgtgctgggcagcatggagcctgggtcattgctgtgttgggggcttggtctccatgacttaatagggtgtatcagtgtgtcccagagaagtgtactccagagtgctcattttctttcatgtttctgaagcaaacagtgcccccttttttagaagtttgcatgtgtcactgataactttaataattgatcttgttgaaaaacctgggaaaacagtgagttaaataataacttctctgaacatgaggtccagcccaattacctgccctaagcaaactatatggaaggagagttcagtttgttcagctatgtggtcccagcaaggactgtggtactggaaaactaaccagcttacatgcactagagaagtagaattggacagtgatctgtaggtacccagtttggagatgaaattgcaactctgagttcttgattggcaacataaatacgttgatagtaaacagaccctggggaatcagcacttgagttgtgaaaagcgggaaatagctatgcctacactagagccattcacacttttgctggagctgcaataatcttctaagtcatgcttgctctcgtgagggcaatgagatggtcacaatccaaggagagttggggttttcacttttcatttctctattaagtgaaaaaagtatatgaaaattgaaaaatagatattacttatgtaatcttcacagtataatttgcttgccaagcagtcactgggatttaatcagtttctttgtctttcgtttttctcataagctgagagagtaattttgtgtgcacagaagtactgtcttcagctacatgctgcattaaacattcctagatgtgaaatgattaaatttccaagtttttaaaatgtggatttttctggccacttttatatctcttcaatgggtttctaatggatttaaggagagagcctagtcatgatgaatggtgttgtgttgggtatgctgaggaaactttgagaccaatgtttcagaaaaaattatttctatactgtcatgtttcaagtaccgagtattgttcttgtcatacagatggtccagtgaacatctctggtgaattccttacaaccaacctcttgttactaaatattccattaggaatgttttgtttctcaactccctgatttcccctttatagattggaagtgatattggtggaagacaacattttgccgcttggaattctcacctccacaccaaagaagtactgtttttgtcatttgcaccagcttctttctccaggaaagatcaaaacgatgcactgcaaggttaacatccaatttttaatacatgtaattccctggattatttttgttgtgttattaaataacttagaattttttttacaaagtctgttgaaccaaacactgtaaggcattaataacctggtgagttatttgaggccttttttcctctcctagaatttttgcacaatttatattttgaataatatcagagacatcctagtagagtaatgaattagtacattttatatgcagatacatagtgaagcctcctttcttatgcatatttgacaaatggacatgtatatttctcatcttcccatatttttactccatttccacaggtcatgtagaccaaaatgtgaatgtcatatgaaagagtttaaacattgcccttgaaatatgacagaaagtatcagaaataattataccattccatgctcacaggccagtgggaattctcacagtaagcattttgtccagagaatattcttcttagggaactataacattccaatgataatggtagtcagccatgtggctggatcatcgttcctgtatcctggtctctatgacttagtgtggtgatggtgtcattgtgtccaagtgtgacagaattgttagtgtgtagtgtctgtctcctatctcaggctcacagtcccttttataaacatgcctggattgatgatggcttcagtatcttttggaaatctggactgagcaatagaattgcttctctcaaattgatttcaagtcatataaaaggccatgttacacatatattgttaatctgagggaggctgtgatcatttaagttgtattttataaacactaggaccaccagtaagaaaacaattcaaaaaatattaaaagaacaaccaaagaattaaaatagaataaccgaaaagatctgtttaacacaaaagaaggcagttaaagatgaacagaggaaccaataagacatatagaaaacagataggaaaatgacagacataaacccagccatatgacaattatattaaatttttaagagattaggaaattccgttgttttttaaacatgagcaactatacgctgtctacagaagagacactttagaacaaaagatacaaatagttggaaagtaaaaagatggaaaaagctatatccagcgaatccagaagagagcagaagtggctattctgacatcagaaaaaagagactttaagataaagtattgctagagaggaagaaggatagtatttaatgatagaagggttaatatggaatatgtaacaattacaatcatatcagcactaacaacagtgcccaaaactacatacactgaaatttaacatgattgaggggatcaataggcaattcaacaataaaagcttttgttcataccctcttcttaatcagtgataagtcaattagatagagcatcattgaggttacaacatacttcagcaatgttgtcaaccaatttgacctgagatagatagatagacagttagacagacagacagacagacagagaaaacttcacccaacaacagaaatacaaattattttcaagcatacctggaacattctccaggatagagtatatgttaggctataaaactgtactcaataaatttaagattgaaaccatgtagagtatgttgtgtgaccatagaggaattagaaatcaacacagaaataaatttggaggtcacaagatatttggaaattaacacactttacagagcccattggtcaaaaatatatatattaaactagaaaggccgggggtggttgcttacacctgtaattccagcactttgggaggcgtaggtgggcacatcacttgaggccaggagttcaagaccaacctgggcaacatggcaaaaccccatctctacaaaaaaatacaaaaaatgagttgagcatggtggtgcatgcctgtagtcccagctactcaggaggctgaggtaggggaatcacctgagcccagcaggtagaagctgcattgaaccaagattgcaccactgcataccagcctgggcgacaaagtgagaccctgtctaaaaaataaaaggaatccagaaaacatcttgcatagaatttgatacaactaaagacatgcttagagggatatttatagttttaaataactgtatcagaaaaaaagggaagataaataaatgacataagcttccaccttaagaaacaagaaaaagactaaactagaagatgaaatccaaagcaagcagaaagaagtaaacaatagggattggagcaaaaattgatgacataaaaaaccagacaaaatacagagaaaaatccatgaaaccaaaagttgggtttgtgcagagatttgtgaaatttacaatcctttagctagactgacacagatcattagaattaggaatgatggagacaacatcactactgaccctatagattggatcaggaatgtcgctgtttgctgcattgtgctttcttgaggggagagctatgaaggaaaacaaagttctcattgcacttacaactcaacaacacagcgttgacattttgattctcactggcttcagtgctcatctctgtgaggtttccagaagatcccgtagcaatatcactcattctaaatttatctttgggctactctgggaacgctgtctatgggttagccctgctctgcaaggagcagtaagaaaatatatatatattttttgaggctgagtctcgctctatcgcccagacgggagtgcagtggcacgatgttggctcactgcaacctccacctccagggttcaagcgattctcctgcctcagcctcccaagtagctgggattacaggcacgtgccaccacacaccgctaatttttgtgtttttgtagagacagggtttcaccatgtgggccaggctggtctcaaactcccaacctcaggtgatctgccctccttggcctcccaaagtgcagggattacaggcatgatccactgtgcctggcaagtatgtttgtagccagtggggaattattttaactaggcaataatttgatctattttgggaagcctcttgtaatcaaatcatatatcaacattaatcacatggtgagtcctccatggttttcattcctagagattctaggatgtttgacatttctctgcttagcttatagcagaaaggtattggatatcaagaatgtttgaacagtttctcctttttgggaatgaagatgaaattgggctagaatgagatgtgtgattgagagaatgtccctgaggcctgagcagtgtgtccttttgggtatgggcattggaagcatgtagtgaattcttataattttatgttgcctcggcatccatcttgagtataagtttaactttgttataccagaagcaaggcttactcacttttgcacagtttccagttctacacctccttctcgttcctcagtgtgattggtccagatagctgccttatccaactgcctcctttggaccacttcatcatgggacagcttgatgcaatctacttgacaagaccctggaaccccacacccctcatggaaccagtgtccacctcccagtcacagtgtgaccccagggaactcttgcctgcttgctttaaacccaccacttaaaagtctccacagaaaacctgtttgaatagtacccttgacccaataagggcattggcccctgggtgtctctctctctctctctctctctctctccctctctctccctctctctctctcgctccctgacctctgcgtgtggactccaggcatgccatatacccctcaggacctgtaagtaatactatctttatttttattttatatctctcctaatcattgaaaaggtgctctctatcttgaagatactatattaaataaaatgagaacttgtccctaacacagttagtgataggctgaaacacgctgattgcactctttacccatttagtgatttttctcaagttactctacaccatgtattatcaacataattgatattacagaatagaattataagacacttcttttgccacagaaagttctattggactcagattatctagagctactacatgtatgctattctatgataaaagatgtagatgtgataaaaacatttataaaatatctgtcttagaaaagttagctaaaattattttgggaaaagtatgtttgaaaatagaatcgtaagctaccacattgtgataaatatttctaaatgtgtctattaacttgtcaggagacaacagagtgaattaaaacagtagccttgtatcagtatgtttttattcagaagacaaatgcacgttttaactattatatgttcttggcttaactttttttgtaaagttaagacattacacttttacatgaatctgtaatttcaagatatcttaatggttgacagggacaggacaattgaagaaaacctgtaaatacatttggtaaaatttatgatggattgttttgcagatggcttcagaggttattagcacatctgtttgagatatgcacagttttacatttgtcccttaggtaatcaacagggctgagatcagtaaatcacatgtaagccactgttatgaggctattctgaatagagttacatcattttatcatatctagactttctagttatattggtgctgttgaaaatgattttgtattacatgctttcttccaaatcatagatcaagatattttatttatgtatgtcttttaaatgaagagtggttaggatagtcctgattattgcacataaatattgcctttcactagattattgttttgggccaaattttagactattattttaaaaaagagtaccttagtttaatccaacctttccagatacttagaaattattgaaatgtatattttgtgaagatggtcttatgaaagttgttgagctagaaacatgtccttcaccagtggaattcttagaagctttccttgggcttcactgggtgctaatagaccatgatcgtattgctctgtatataatggtacaaattttgttttataacactcagtcttaatagaatgggaatattttatcttactaacgtagtcattagctggccactctctgtgtccattggaccttatagggtaaagggagggcagtgcgtatttgaagcctgtgcacgtgacacacaaagggcttagcaacctccgtgttttcccagcacaggatacccattcttcctgaatgtttcattgttaaattagattgtgtgtgtgtgtgtgtgtgtgtgtgtgtattttatattaacatacagatgtatgtattttagttgcattttttttcttaaaatgttattttttctctttttcttttatgtcaggtgatgatagagcccctagggaagcaaaactgtccatgcccttgccttaactttcagatacgataaaaacaacatttataaaatacctgtcttagaaatattagctaaaattatgttggggaaagtatgtttgaaaatagaattgtaagctaccacattgtgataaatattactaaatttgtttattgacttgtcaggaagcaaaagaatgaattaaagaaaactccagagaatgagctgacaacctactccctggtcagtggctctccatgcctacctgtggtctcttggacacccttgcaggtatgtgggcagggaactgcatgtttataggaaacaggcctaggatggaaggagttaatagatcttgctcttcttgagtttgatgacatttgtttccagttaaatagcatgaaaacccatctgagagccagctgagggtggatacagttctggggagttaaagacgagtggtcacaacaggtcttcctcggcaatccgagcccaaaactgaatctgcctccataagaccattatgtgtcagctctttatttatatgattgattcatccagtggacttttaatttcttatgtccagatattttttcagttctttttttcgtgatacaagcaccttgtggattgcctgtcatagaacaggttctcaataaacttttattgaaaaaagatgtataagtagattgtcttgagtaattttgtgaataacctgaccaactaagcagtagaagacaaatgattttaaaacagaaagagacataactttcagtgggattcaggtgatctagtcgggtctggaaatgcgcaagagagaaggtccctgatgcagtgtgctgacattgaaatgtgtagttgtggactagatggttatggtttcagaactgtgtaagtaaggggtagattccaaattaaatcaatattaaagagtagcagagaaggaatttccagattccagctgcattgcttgtttcattggaagtggtgtttctcttttttcttttttttctttcttttttttttttttttttaaacctcagaagatgacttcctgggaactcttctgggagtgaatgttatcagcaaattcccaaaacaacaccccttagacaaaaagcctcctcacctatgcattgcctagaccacccactaaaggtaagatgttagttaaaatagtccttgctttctgggagaagccatgtcttagtagaaattgagctgttaattttccgaatattgatgatgtttgattacattctaattgattctaagatttcataatatgttaagagatgcagcttttcttatataccttcgtggcttttctacatctcagtacatttactgttaatatgaaggatttccataacttctctcatctagtaaactgaactccttcatggcttgatccattgtgatgctagaaaattgttgtacacagaagacacagtagcctctccataactgttagactggaagtttgacaaactggtctgaaataactgatcaaatcaatgaatgacctagagctttaagaaaccagatgggaagagacagacatgaaacccaaggttgttgatggctattacttttgagcccagcaaaaggagaaaaagcagcaccaatatctggcatcctggacatgaggaagttttaatgtcattgttttggcctcatcatggacccaggtgctagaaatgagattttctctgtgtactctgggtatatttgttctagcacaagtagggggaagattaaagaggaatttcatacccccatgactccttaggaaatgtgtttctcacctttgccacttttccccactgtgtccttgcaggtgatggccacaaagaggtggatttgttgagttggtgccattccttctactgccagcttcaccaaaacaatgacacagtcttccttccgcatggagactcttctctttcctgtgttgcagtggatgcctcctgcagataagaaatgcttaactgagaaatgctcatgttgggatatcatcgatgagactttaatttgggcatggtgactgtttcccttgctgccacttgactcaatcccaggagcctcagtagaggatataatattacacaagatgctcaaaatggtggaattgctcagtgctcccataaatatacatttataattttcatttgccacatggtaaactgaaaaatacagactatattaaaaagaaactgcatgattttttttcaaaaattcaaagcatatttaaataatatataaattaaatgccctcctctcttccaattctgtccctatagttttcctctattaagtgaactacatgcattcttttagtggatagatgcacacaaacacacaagccattatggggaaggatccacgtgtgtggccatattgtaacacatttttctgcaaatcacctctttcatttaacagcccttattcaatggcctttttctttttcagtagtacatacacatctgtgtcatttgttgaatgacgacatgaatgttttgtagataaaatataattaaatgttttaagcatttctcactcatagatatttatgttagcaccaaatttctgtgcaatgaacctccctatatatcagtaattttgcatttgtctataatatcataataaattacttatcagttgaattactgggattaagtatgtgcacactttatatttatattttgaaaattattgcaagattgccttcaaaaatgtggttaacaactttatcttcaaatggcaatgaatgagattgccagctttcctacagcctcacagacaatggattttataaatatttaacatttttgccaatgtgatcacccaaactattgtcttaaattgtatctcttttgtttttgagtttggtcattttttcatgtttattagccatctgtattttttaatttcttctttatgtccaattttgtgggtgggaggaggatttagtctcttcctgatttcgaagagctcatttactatttcgggaaataagatttggattgtcaaccattatagctattttttacacacttttcaactttgtttttgttataagaatgtgtatgattgttacatgtccaagtataaccatgttcgcttttatggcttctgagtttcatgtcatttttggaaagatatatatattgagtccataaaacccttcacctatgttaaattctaattcttttgtgtttttttaattcaaattcttaaatcatgagaaatttttttgttttgaaatcttaaagttgccaagttacttgccattacttgcgattatttgccaataattgcccatttatctgtaccgccatcttgcgcatatgctgtactctcatctgtgactggctccatttttgttctgtggatttgtgtgtctcttcttctgcctcctgtctcgtgtctgctcgttggaagaaattacagtttagactgcaatttcatcaactttaataaatcaattgaggggagaattggtttttaaaaatattaagtaagtcttcgtatccaaggacaaggtatgtcttttcttattcaataattttaattactgttaatattttcactgtggtgatgggagtttttcttttaatttattttcttgttcattttttgtatctaaagtttttgttttgttttgttttgggggtaagttgtcaccttactgtttcttgttgcttttcagattttttcaaagtatagactaaatccttcacaaatatttaaagtttttattttcccccttcatattgatcctgattttagttatgttgacaaagtccacagactgttactatcagaacacttgaacagttatggaaatattacctacccttgatttaatcagagtttaatggtatgcttctttggtttgactggcacattgtcgctggtcatttcctcccaaagaccaccagaaagagctatgatcaagcaaagctgagtttgttaaacttacctgcagcaagggaaaacaccaccttgatagggtttaataatgtttcaaaatcaagaaatgaggctttggggtctgggcagggaactaattagaaatgggcaaaatttgtcatgcaataccttgtgggaaagtgagatgaggttcttaatgtgagtattgatggtgaaatcattttctaggtgagctgtttgcctatataaagatgttatcaatgacagaagaactatttgcctagataaacaaactgaatttatttattggtttacagttttatcttgctgggcaggactctgctgggggtggtatcaggtcttattcccaataggtaagttatttggatatgggtggtcttaatcatcaatgtgtaaaatgctgattttaagtgcgaaatactttgtctaccatgttaggaaagtctgccaccttttatcttttttaaggaattttaatcaaaaccaggtggtagatataatcaaattgttttgcagaatcaattttcctgttctctttaaagacttttatcactgtgaattaatttactattattgcaacttcctttaattccttgaatgaacagaccctactggttttaaaaatgttttattcttttaatttactacttaattgtgggtattttaatttgatttggaatttttacaagtatacaactaagtgaaattgatctgtgatttttcttttttgtgctatttttgtcatgttttgatatcagatattctggttgtgttaaaataattttgaggattttcttcttatactgtgttctagagtgggtaaaaaagccctagtctcactatcagtgtttaagtgaacacatcagtgacatcatctggactctcctttgtttttgctggtttggagttaggacatctagaagtttttttctttttttcctttttttgtatggttattgcttgttctttgttttgtgtcaaatttaacctgttttctcttagcaaatcacagctcatgcagattttcaaacacattagccttgttatacaaagtgttctttcatcattctattaaatttccattttcattccagttatagttatttctgctgtgcctttgttaatgaataagtttaaacagtggatgtttagcatcactagccttccccttccatctcccttaatcaggaccttggtataatttatcaggtattttttaaggttctaatttacttatatatattgtttctgtattcttttgtttcttttcttaataaattcttaaacctgtgtaacacattcatattcacttgttcttggcaatgaaagatttaccctgctgtgcattttataaaacttgtcattatgaacacattgtaaacatacagtgtatgaagagaagaaaacagtgaactagcacatacaaggaactggaactggttccatcattatcagtattttgccatatttactttgtgtttattttaagtattttcaaataagctagagaaatcttaacgcttcttattctcccataaacatttttacaattttatttttgaatgtgtatgtatacacattcgtatgcttttatattgttctataactttcttttatatcatgtaatatataaatattttaatatttctatctgattattacatatccatagatgtgaagcttccctatttttaataacttatatttttacataagtaaaatttacatagttaaatgcattgatatatagtaattgtataattcaataagtttcttaaaagtaattactatcccattcaggagatagaatatttttattacttgagaacctaccctattgcctctttccaaccaagcaccttctcaaaaaaacaatgttgtgatttttatgatcatagataagttttgcctgtttggaaattaatataaatggaatcacacagtgtgtgtctggcttcttgcactcatcataatcatgttgagatttatctgtgctattccctatatcagcagtttaaaaaagtttctatagttgtaatatttcactaaatggttatattgcagtttatctattctcttgttgacggacacctgagtagtttctagtttttagctgttttgaatgttagcagatctcttatgtaaatacctaaaaattgaattgtttgatcataagacagattttgcttaacttataggaaactgctagagagtcttctaaagagatggacacttttcgcactcccaaccagtgatatgagatttttagttgctgtccatttttgccaacattggaaattgtcagtcttatctattaagtgggtgtgaggtgatattttgttgtgacttcaatttgaaatttgaccacttaagaaggcaaccagtttttcatgaagttatccaattgtaaatcttctttagtaaaatttgtatatttttcccaacttttaaattacaattttgaagtaattttggacttacgggaaatttgcaaaaatagtagagttcctgtgtattctgtacccagctttctggatgttagcattttatataatcattattataacattattacatacaatgataattgaaatcaggaaattaatataatactgtcaaccaatctgcagactatattcaggtttttcaagttatgctactaatgtcctttttatctagtccaggatccaattcaagatctcttattttatctggcatgtttcctttgccctctctcctgactacaaatctgggagagctccctcagtctttctttgtatttcatttaattgacacatttgagaaatactagaccataatttggtacactagtcctcaatttggatttgtccgatatttttattattagattaaggttatgcacttttgacaaaagataacacagtagtaacagtgtgcccttttcagtggatcatctggagtacatgaagttaatgtcttatttctgctgatactaaatatgacgcctttattaaggtagtgtctgccaggtttatccactgcaaagttactgttttcctttctttgtaattaatattttatgagaaaataatttgagactatgcaaatattttatttcatctaatttcagtattaattgaagattcttgcctgcagcaattatgattatggtgtttacctagtaatggtttctatttccatgatactttctctacttactagaatttgactgtaaggaagatctgtccttcttccccatttatttgtactcagttgttattttacatcagtatggatttgtggatatcttattttatggattgttatatattgcaatcattgtttgtgtttgattttcaattttttttctggatttgatcattgggagctccttaaagttggcccctgtgttcttttaatacaacctcataattttttgaccacttcttattttcgggtatcacaagatattctaggtttatcttgtattttccttccccacgcctgtaatcaaccatttcctcaaggggttctagttcttcatattggaaaatagtatttagaaaccaagatcttggtattaagtgtattaattgctaatggggttttattgcttctaggcctagagctgggagctgtgtgtccgtttacacacatacacatacacacacacccctatattgtctctattcatttatctatcttaaatatatatactaatagtatgtagaatactatagatagtatatatctatctttattaaaaatcacaagttcatactgttgtggatcataatccatcatcatatggttcattttattcttccctcttggcttatttgtgatttgcttcttcaacagtgagaaacctacctttcattatctacaatatgttttgttatttcttcagtgcagtatacacttaaataatttcagaattgctaaattatacccctttaaaaatgaaatcactaactacagcacagtatttaaatatagttcttttgtctttatccttaacagcgttcagtcaacatactattatttctaaacgtatttaggttagttatcttttttttcctatcccctgccatatggttacattaatcatataatcaagcaggtttttttattgtttatattccattttgagttccctcaccttttggattattttaactatattttgtatatgtgaaatattactatgtttctaaaaattaggactgtgagaaataccactctcccatcatccctgctacactgattctattcctcccttctttccaccctaatctcacccaacccttagagttaactagtctaatagtttctggtttatttttttctcttgttattcttgttcacaagtgggcagatacatgtatattttatcatatatcacatgtatattttatatccccttccttcttacatgattagtggcatactatagatttttttttgttgcagttttctttttccgcttaatatgtcctggaaatcacttcatgtgtattcaaagagatattcctcattctgtcatgcttagtgcttaactccatggatgcaccacaatttattcaacccctctgctctatgagaattgtttgcaatatgtgtaaagtatcacactacaaatagttttacattggattgtttatttgctcttcgtttggaagtgttctttgtattactgggacatacatttcttgttcaatatatgtgttgcaaaggtttctttcattaagtatcttagcctgcctgccttcctttccatttcctttctttttcttttctttcttctccttttaatgctgttatgctctaaattttaaaatggcccgaatttgccagtggctcatcccttattgctatttattcttcctctccttttctcccccatctcttttcctttaatttacgtgaaattaacataacgtagccatttagtgcattcaaaatgttttgcaactgccatccttaactagttccaaaacattttcagcaccccaaagacaacccatacccattaagcagtcagtcccaactctctttccccatcttttcatttttgttttttggagtttttttgagacaaagtctcactttgcacccaggctggagtgcaatggcacaatcatagctcactgcagcctcaaattcctgggcttatgcaatacttccaccttagcctcccgagcagctaggactacaggcatatgtcaccacaccaggctaatttataaaaaaaattttttagacacagagtcttgcagtgttgcccaggcttcttgtgtctttcgataaacagacattgaaaatttttaagtccagtatatcagtttgagtctcttatttttagtgcttattacttactattaaatctttgcttactccaggtttgcaaataatagttttctaagttttcttctagaagctttgggacataagtataacatctatctcaaatcattttcaaatgtagttgaagttacttgttttcatcaatctccagttgttgcagaaccatttgatcaaaagatttttctttttctactgaattatctaatgccattgttgaaaataagttggccatttacgtatggatcttttttgaactctctgtttttccttctttatgccattctttttcactgaagtttaatagtaaatcttgagattaagtagtgtgagtccaaaattttgttatttcaaggctttatagaggaaggagatggctacactgggtcctttgtatgttcacttaaattttaaaattatcttgtcaatttcctaaaaagcccaaccgagaaattgattttgattacatcaaaactatagataaatttaggggggattgacatcttaacaatgttgagtctgtagttctccatttattaggtcgtctataatttctcatagatgtcttttatggtgtttagtatagaagcataccttgtagttttcaatatagaaacattattaaaatttaacatttaataaactagattaaattgttaaatttatttgttttgttgttttgatgctattgtaaatgaatatgtttaaatttcgttttccagatttgttactattatatgaaaacagtaatattttcacattgcaactgcttttcagttgggttgtcttcttttcagtcttaggagaaaatatgtaatttcttaccattaagaaagatactagctgttatttttttgtagatgcccattaccaaattgagcaagttttattctagtgccagtttgctgttaatttttataataataatgtgataaatttgctgaatgtttttctacatttattaatataatcatgttttcccccttattctcttattatgggagactgcattggtcagcttttgaatgttagcccaacattgcattcttgatgtaatccaattggtcactgttatccttcttgtatatatattactgtattcaatttttctgctagttatttaagagttattcacctatgtccgtgatggccattatcctgtggtttcctttttaaaaattatttttgtcagatgttggcattaggcttcataaaatgtatttagtatagtgctctatttgctagtacacttgacccttgaacaacagacatggagattaggggttcagactcccccatagttgacaatctgtggacaattgtttgctctccagaaacttaactacgaatagcctactgttgactgaaagccttacagataacataactagtcaattaacacatattttatgttatatgtattacatactattttattaacaataaagtgaatgagagataaaatgttattacgagacataaggaagagaaaatatatttactattcgttacgtgaaagtagatgatcataaaggtcttcattctcatttttatgttgaataggctgaggaggaggaagaagaggaggggttgttcttactgtatcggggtggcagaagcagtacacttggtgtaactgtatggaaatatagtttctagcttttttgatttttcatttctctaaaaatgtttctatatggtacagtccttcttccactgtttacttatttgtagtacccacatcatagaaggagccatattgtaaagaagtcaaatgcagacttaaataattagaaaccttctgccagcgtgtttttctggcactccttctgtgtcgtcttccttatcgtctggtactggttcagaagcacttgtctccatcacgtcatcttctgttaattcctctagtgtgttatctattagctcttgaatttctccaaggtgtatatcttgaaagccttcactcaccacccttttttccgtgttcacgatctctttcgtgatttccttggttggctgtattgtaaatcctgtcaagtcatgcacaacatctggacacagtttcctccagcaggggagtgtgttgtgttgggcttgatgctttcacagctttttgtgtaacgatggcatcttcagtgctgtgatccttccagactttcatgatgttctatcagggttctcttgcatagtgttagataatcctttccataaagtactgtgtgtaatgagccttaatggtccttatgactccctgatctagaggatgatttagagatgttatgtctgggggcaaatagaccactttgacaccttcagtattgaactcatggggtcagggacattgtccaatcaaaaaaaaaaactttaaaaggcactcacttactgcaaggtacttcttgacatcagggtcaaaacatcaatgaaaccaatacagaaaaaaagacttcttattgtccaggcctttttgttttacaatcaaaagaccggcagctggtgttttaacttttcccttcgaggctcaggagttagctgctttatagataaggtcagtcctgatcataaacccaattacatttgcacaaaacagtagaattagcccatcccttcctgccttaaatcctggtgctcacttctcttccttactaataaatgtcctttctggcattttttttttttcagagtagggcactttcgtcagtttaaaaacctgttcaggcagatatcctttctcctcaatgattttcttaatggcatctgggaactgcttctcctgcttgactgtttttaagccagacttctttctaaaattatcaaaccatcctttgctggcattaaattctccagatttagaaccttcaccttccttttgcttaggatcatcttgcaccctagaggtatgccttacagcaatcctgtacccgcagaaaagatgcattttcaatagatagatactttgcaaaagtgcaaggttttcacagtgttggtacagctgcaacaatggcttcatgaatttccttttttttttttttttttttaacaattgtcctcacactggatttacttatcttgaaatggcaagtagcccctgctggagacctcaatctgtggtaccttttaagcaattaaacgttttcttgtaatgtcatgactttcctctgcttcttaggagtacttccagtatcaccagtggcacttcatatgggtcccatggtgttaaggtttatggtattacacaagacactatgaaaagtaatatgagaactgtgaaagcttttgttttgctgccacatgcaatttactggagggagaaactgtttcctggcatgatttcgggtcacctggcactttaagcagatgcaattgagctccccactgtagcaaaaggaggtggctacaaaattattacaataatgctgggtgtactacagctaattttatgcagttaggatttaataccacatatttacatttctctcaactgcaaatggcaccatgtaggatctgtgagtatgtgtgagtaggttttgataaattttaactttttataatttgtgtatattttatggtaataaatgataaaaataggctagtatctacatctattttatgcattcatgacatacctttttcttaatttttttggtatttctggactacgcagttgagttttttcaaattgtcacaaatttccaaaaatgtatccaatgtatttattgaaaaaagtctgcatataaatagatcatatgcagttcaaacttgtgctgttcaaaggtcaaatttctttgtggaatgtttgatagaattcattagtgaaatgatctgggcctggagtttccttcgtgatattttaatgaacaatttcagtttatttaataatacaggattgagagtttctgtttcatttaatggcagctttagtactgtttttcaaagagtatagtccattttatcagatttgtcaaattcagtagtataaagttgctcatgatagttccttattacccttatactgtctgtaagatctcacctttccaattctgatataggtaatattattttttctcaggttggtctttttttttttttttttttttaactatcttgtcatttaaaagaatcaatctttgatttgctaattttctctttatctgttttttatattattgatttctttccttcatcttaccttggttttaatatgctcttttttttggtagcttcttaatcttgagactattaagtcttctattatgtaccttacttattttctaatataaccattgaaggctataagcactacattgatagattccacaaactttgatatattgttttaattaccatttaattcaattattttcttcctttgtgttttaatttgatctgttatttttaagtggagtatttaatttccaaatatttggggcttttctgtgtagtttgttacaacttctgttttagttttgttttggttctaaaaagttactctgatatttcagctttccaaatttattgagacttatggtctagcatatgatctgtcttgacaaaagtttcacatgcacaggaatatatatttaaactcaaggtgtgcagattttgttcagatagatagtgtctagattttctagattgtcagtgaatttttacaattgttttataagttacaaagagaatagtgtaaaaaatttctgctgtgattatgattttctttatctttagttctctcagttcttcgtgtatttggaaatatcttattgtttatacttttatgaacatcatgactgtaataaattttatcttttcctaatttggcctgtcttaccttatgtaatatttctggtcttgatgtctgcttcgtctgatatctgaataatattaccagttttcttgggtttgcagtatgtctggtgtatctttttctgttctttaaatctgtcttcatagtgcttccattatagagagcatagagatggatcttttttgtccaatttaaccatcagtgacttttaagtctttggggtcttaagtccctttgcattaaacatactaacgtgactagacttatgcctactatttagctattgtttttccatttgtcccctctagtttgttcctctctgcctgctttgcttcgttcttttgggttaattgaatatttttagtatcctacattaacttctctgtttacatttcggctccacctctgggtattttgtatgggttataaaatgtacccttaatttatgacaatctgcttagagttagtattgtacacttctcatgaagtaaaattttatatatatatatatatatatatatatatatatatatatatatatatatatatatgagggagtctcaatctgtcacccagactggagtgcgggggcatgatctcagctcactgcaacattaggtggaactgtattaactctaaaaggactgtgataatttaaagatgtatattataaccatagaataatcactaaaaagtacagagaaatatagctaaaaaagcaacagcagaattaaaatgtaatagtaaaaatacttgattaaaagaatacaggaaagaatgaagaaaagaacaaagtaaactgtatagaaaacagatggcaaaatggtagacctaaacacagtcatattataaattactttaacggtacacttgtttttcattgctttaattgatcaaatgataggtaaagtattttaaagtctctttgtagttttctttaaatcttaacattttgtgcaatgtttgctttgtgaagattgatgctatgatatttaccaatcatttagaagagatattgctgggtgttttggtaagtttaggttacttacatatcttatatgatgaaatcaacattttttatttgatcaacttaatagaggcatcctgtttgaaagaagaaaataacagatctacaaaattctgattcatgtaataagtaaccattatgataataaatgtttttatttattgagtgcatactgaaaagtggtaggaagattttgtgctgaaatatttgtaaacctagtaattaaaaaatgttttggctgggcttgttggctcacgcctgtaatcccagctctttgggaggccgaggggggtggatcacttgaggtcaggagttcgagttcgagaccagcctggccaatatggtgaaaccctgtctctactaaaaatataaaaattagccaggcatggtggtgcacgcctgtagtcccagctactcgggaggctgagatgggagagtcgcttgaacccaggaagcagaggttgccgtgagtcaagattacaccattgcactccagcctgggtgtcgcagtgagactctgcctcaaaaaaaaaaaaaaaaaaaaagctgctaattaccccatgctaaatgtgttgtaatggtattaatttgatatataacatatatgtaacattttatatatgtgctcatatgatgatactgataatacctccctcaaattgctcttttgagtattaagaaaagtttatatagaaaaaccagtttggaaaggtttggaacataaggctacagtgattagatgttgagaacagcagcaataatagttgtcattataatatctgattaaggcaatatttgcacccaggtataccttgcttcagaactgtgtgattaaccattataccttgaggctattcataccctaccttcactttgttggcataatctgaagttttaaaccataatcacatattgcatttgcacaattaaattttaaaatatatacaaattacagtcaaattattgcattcatttcatgactatattctgtttccatccataagtaccgtatggtcaacaataacatgtcaaagagaattttgttgtcacctcgtttcattgtaccatgttcacactgttctttatctcttttttccattggcagtattgtgttctcaagaagaattattccagaagcacccctgaaataatatatttccttaattttggtattattagcccttctttgcttttctctataaattgtcctgatcagtcacctctctcaattatatacaacacaaagtagcttaaaggagaaaaaaaaggagataaataaccatgttgggtctggcgtcaggcttaatggagtccagtagtccagaatttaaagacacatatgaccgtttgctcccttatctcttagttctccatttcttggtttggcttaaatcttcagtcactttttctttatgtgaatttgcaaagggatcatttgaagccctagatgcaattattacctgccttgcaatcttggtaggatgtgtcctccttccctcctccttgtccatgtaaaagttggtgggtgaagagatggacaaggcttgagtcactaagacattcactgacctgggaataactcaggataggtctggtcatatccccaatggaggcaatgtaccctaatgaaaaggtcagggtcactggtctcattgtccaaggtgttatctgagctcatggtctcacaaccaagaaaattaaggagtatggacacagggtgaggttggttggagcaaaagtttagtaagcgaaagaagaaagctctctgcagcagagaggggagtccaagtggattgccgtttttacagtcattcaaaagcttttttaagaaactcctctcatctctgtagcactttgagtaacttctcttatcagcaaagctgtctgtacaactccccttatcttatgcagctgtgggtatgtctctaggcaagcacaaagcgccgcttatttttgtttgtgtaactgagggtttgttttaggtaagccccctcctttctgtgcaggcttccagggagcccaccatgtacatatctgaaaagggaaggaaactttttgctgggagcttgttaatcatacaaagaataaagggcttccatgccagactttgcctgcctgcttatctatggcttatctgtgcagctatagcctgagtttcccctggctgctctgtttttgcctgtagctgtgattttttcaggcagacagcttctctgaggactagtctcttagctgtttactcaagtaatttttcctgtccttttccctcactatgattaccagctcccctaggacttcatggtctggaatgaaatattccgtgggagtcagggaaagggagtttgttgcaaacatgtccaggccagacactttatataaagtgtcaaagtaaagtacacttacataaagtgtaagtgctgccaccaccactagggtgccaggtactctaacacaagtctttattcccatagatgtgagttaacatttataccaccagctcacactatcaaacaatcccacgtaccccaaataaacactggtgcctggtgggcagcaacaagccctccttcaaggaaggagttcatttgttggtttatccagctgctcccgctttgcttatggaagcgctccgttttctaggggtcttagaagctgtagcagtggtagaaagccccttttttgtggactattatgacttaggcttttatcagagcctcagagaattgctgttgttttgttggttaggctttaggtttccaatctgcatacacaattcctttgaagcaccaggcttccaggcaatttggttgagggaacttattgggatatgaaatattatcaggcaccatttctaatcaatgtacctaagttatgacttcaggtttagagaaaaaaaaaatttttttcccttggcttcaggcttccttctggaggtgataacctcctaaatggactgtctttaagggcctgtggcatgtgccctcctttcaggaaactagtgtatgcctggaggcattggtaatggcttctctcatcttactgtggcttgggaagaatatggctattgcagattttctagtttcattaccacctgaccttcaggctccttacatgttataggcagaaaaggtgcctccacaaagttgtgggctattctctgctttcagaaggacagctggaaatggtacttaattctttgtagcagcaccatcatgaatagctgcccacacccatatacatcattatcttttttggtgaagactctaagacttcaggccatgatatccacaaggctatgttcatgcactacttcggtataatctcaaaataattgccagctccccagtggaacgcctgccttggtccatgtggaatgtgggcatatggtaggatttccttggaggaactagaagaggaacataaagaatgttaggcatataaattattgtttctttttcttcttgtttctttccactgagttatgtgtgagcccccacacccaccctaccttcctgtcctctaccttactgatgctattttcaggctgttgtagaattgggtgtgtaaaattaaattagcctttctcctcttaatatctgtaaaatgaacaaatttgacaaagaaactacctatctgatatataagaaggttattagcctgtaccacaagtgaaaaagtttcatcctgatatatcaaaatagtaccacttgaaggaaaacgttggggccatctgtttctctcattgtagttagagtacagatttttaaaatatgagcctcaggcataaaaatgcagtattagcaactcaacttgaagaagcagttactagtgtcctgggtgggccccagggaaaatagtaccaactgcctgttatatttaactgcaattaaaaatggcagtgctgggtatcttctgtctctgggtcatctcctaaagatcctgcagagggagccatagctagtgtagaggccagccataactagccatggcaaagaccacagggaacgctcttcaacatgctctgcactgatcctctaccctggtgtggagaaatgtcagattcatcactaacaaggttaaaggtgtaaattgagggaaaaaaatgagaaaagttatctttcacataagacttcagaaagaaattgcgtcgtcaggtttggaactggtttgtaatttcatccagttattttcattttaattactgtcactgttttcttcatccttgataaactatgagctctttgagattgtctttttcatatcctgatgtcagagcttcctgtattttctgatcatggtatgtgctaagtaaatgcaatttttagcattttgaatggtttatcaaatgattgaaggagtgggtaataatatagattacatatacagtcagccacatatgtgtatgtatgtgtatttgtgtgtgtgtgtgtatatgtatatactgttgaccctccgtatcaatgggtttcacatttgtggattcatccaatcatggatcaaaaatattctttaaaaatatggttgcatctgtactgaacaggcacaaactttttttcttatcattattccctaaacaatgcagtatgacaactatttatcatagcattgacactgcattagatatgataagtaatctagagattaaagtatataggaggatgcatgtggatcatatgcaaataatacactacatcttatataagggacttgaacatccatggagtttggtatgtggtgggtgatacctcctctttgaggaggtgagtatcagagacgcaggtaaatatgatccagagggcaaagaggcattgccagcctcacactggctgtcaacaccatgctgagttccacgaaagcagcgaggagagggtggtgttcttgtttctggtacaatacctggcatagagaagatgtcacagcaatgttcgtctattgaataagtcaccaaaattgtgaatgactgaataaatgggcaaagggatttgttccctacttgctgtgggaagtttcttgtagttatgacctccatgaaagagagactcgtatctggagaaagttcatagctgaaaccatgagatttaacttttgaagttataatggatctatttttttaacatcataaatgaagattatgcaatactgtatgtgcttcaattgacacaaccccttcccattcagggctgatttatgttctgtactgaatgacaggcacagaagtaaatgtgataatcctgtcccgtcgttaccctttattgtggtcttgctgtgtcccagccacacacttcatactgtatctgtgtcatcattctcatatacatctatataggtacacttccatagacttaggcccatttaatggaggagcaactccaacatttagagatcatgaaaggtacctcatgacatatattgacctagtggcagagctgcttagttctacagcctctgagtggaatcctcacgacagtaaaaacacaagcttggtttctcacacactctacctgctttttctcatcccctttagtctctattccttgctgagatgtgttaggcattaaatggttacagtctacttctgtgtgtagtctccaaacactcagaaacctcaaaatttaaaaaaatacagaacaatatgttattaaataatcagggacaagttaaaatggtaaagagaataggccactttgtgaaatcatatgcagggaagaaaaaaatactggagtgaaaacaatataaaaataatactagatgctgtttcgtagcaccaagtgtgttctagcttctgtggttgttgctttatatcattttatataatctttacacaaaacctacaagcagatattatttcccctatttcaaaaatgagaaaaccaaggcaaatagttggtaagtagtacatatatattatcctaactctgaacttctggattcaaagaccatgttctaggataccattttgtgtaccagcatggaatatgtttttagttcatctatttactctaaaaatgtggagcatgtagtgtgagacagaactgttctaggctgtgaggaagtagctgtgaggatggtagtatgggtccctgtaataatgaaaatggaatatattggtatgtacaagtacatgctcattaaaggaaattgatgttggcatagattgcctgggttcaaattcccatttaccatgttttcctagttgtctctgtggtgagaggaggtggaatgtactagccattaccaaaattaagagagattgttggaaaaagtctcatttagcacaataacacattaaatgtattcaataaatgttacttatgactctttgagaaaacatacgtttaaaaaacatggcttatgttacacatactatatgctggctcccaaaaataaacatatttcccaagaagtgtctgttgataaagccaaatatattcttactacactaaggggaagcccatcttagcagtgtctcagcagcatattaggggcgtgggggacaaaacaggatatctgggatcttgaagtttcattttagatgggtctttcagtgtgggagcttgattaggattgggtgagggtcatgacacagcattttaagattgaacgttaggattttgagatgagggattctacagtgtggaggcataagctgtggtctgatgctttctgttgatgagttgatggtctttgggaagttcccaggatgaacaaaaatatttgcaacttttatcttcctgggcaagagtctcagaacatctacacttatatcaatgaaggtaaaatgataataatgtccccagcgaagacaggaagccatgtgggtagataatgtaagttgtgtcatttcatggttccatggataagcagctgtacttaagctgcttatcctggtggattctggagatccacacttgaaggtatcaacacagaaatatactaagaggattgtggtcagagtttgttgtcagctactgagtgaggagccaggaacatacagcttttaccaagaaaatctataccatccacactgtgatgagcccacaagaccagatatgggactttagccaaattacctaattttattatgtctttgattgctttctggtccttatctgggatatcagagatcccagagagatggcagggatgcaaattaaacattcttcccccaaaaacaacacatttttcccttataaaattactatattctgaaaaatttcatgaacctccaagtcaagatggggcattgtctaacttgcctgctgtttgctatacaatagcatggagtcagctccaggcttcccaaccctttcgaaaagcatgaattgaagaggcttaaggagagaagaaagcaacccagaattccctgtgtggttacagtttgggttcttgcctcaaggcctggtttttctctttttggagtaaagttatctgaagacctctttttctaagagaagaaactaatgggtcaaaatggaccctgggggatgtcagggactacagtgaaggcagacgttagttcacccctgaaataaatttctgtccagtgtgcagacagtagccagcagacctttgtctccatcatccaataccagtcttttcagatctagtcaatgatctatttaaagccaaaatatccttatgagactgtcaaatagtattgtatttttttgtatcactcgtcaagaatagcttagtacccggcaataaattttatagtactgatattaatagatctcaggtgaaagaaaagtcatgtgtcttataagatgggtgaaagccacctccaaatagatactctgttctctagttgtttttcatgttctattcctctgtaagttcagttacaaaagctgacttccacaaaaagttctccagtattgttttggaaccttattttctaatatcttgtcatatacgagttgagtcccaattaatgattcattatgaggaactggaaacgagaaactgagtggctcaccaaggaaaatatgtgcaaacctaacggacaatttggttatatgatttaaccactgcatgcataaattataactaggtattggactcatactgaggagtgattaaaatgtaactatgccttataagcaacataattaaatgtagctttaagccagataggcaagaaaataacaaaaggacgcagattaaaacatgacaatatatggtattgttctatgagtcttgagtggaaactctacatttcatgcagtcatctacttgggctaaaaatcatgtgtagtggccatctccttccaaagaccatcttacttctaatgagttctcattgaggtctcacgttctcagtctgaggtctccaggtctcaagatttctcagcttgaggtctccagtaatgatttaagatggtttatgcctctttgattggaagacatcactctcagtatcaactccctggaattttacttctggatgagtcgttaacagtatccgatagggtcttttccatcagggttcgagggctttctttctcaggtatctctcctggagatacctgagaccaagcctctgaatttagaccatgtgagggtcatttagtagaggaaaagctgcttgtttacctcttaataagactggataaattgcctgagttacctgcaatatttggctgtgatcacttccaataatgtagagtctagaagcagaggagatattcctagactcgtgggttggcctgttgctaactcaaaagggaagatttgatgaaccccagaagttgagctcattgtcattaaagcaaacattaggccatgtgagtttgagagtctttgatagttttgctaatttgagcttaaactttttgtttattctttctatatttcctgaagattagagtaatatggacagcagcgtttctgtgtggactggcagagctgtacaaagctctttatcatctcagtaaaatggagatagtttatacttgtactagagagagagtttgggaacataaaatcatgtcaaattttgctctggcagagctggaaatctccaaacaaggcctcaatctatcctccaaataagcgaacaattaccatacatactcaaaacccattgcagaaggtacttacaaaatctgtaagtgttctaaggggccctgagattcttgttcatgccccatctttgcatttttaccaagattatactggtaacaaataagacaccgcatgcaacctcaataatcttagtgaaatttctccatcaatgttgattgagtgcagtagccaatttttctttgcttaggtagttaattgcatattaaatgtttgaaacatcccgtttaaggtcctctggcgctactaagcatctatcctagagtgtgagagattttcctcttgcaatttacctgcagatttatattagtaacggtttgccaactgtggaaccaattgttgacattctataagaacctgtttgaacccgtcagaaggtttgattatgaggaccaggatcttagtgagggctccatgctggggcctcctggtatccccatcttgtattagtgtttgtttttttaatagccacatctttagcaagctttacaatactcaaaagttcttttatttgctgaccatttttagtagaggctcctgctgagattgagaactctgtttgttcacaaacaagaccaagaactacacacaaagcatacctgccaccagcactctcctatctcactcaaactgaccagatctgtagagcgaaatgagtcctgtcatctggcagattttgcctctggtagtgattataagggtgaagtatgtcacatcatgtgccatctgatattcttttgtcccagtcttaaagtacagcacatcaaagaacaagatgaaacatggatttttaaaaagagattactaatacatctatttagggcatagtttgtaaacaaagacagtacacagcttcttcttaaggtaatggaaaaagtagcaattttgaaagtattgccataagtaataaagatgtgaggtgctgatgtgaagtaatatttcataggaatttaagcctctatgctgaaaagtatgtattttcaattttgtgtattttcagtaaaggttatccagcaagagggactatgaaacttaaaggagaccctaacctaaaccaagccagcagaggcttccagtaatttagctgttgtggctattgccactgggtgaagatacagacttcaatgagctggcccctgaggattctcctgaaatgcatttagaacaccaagagcttatccccagcactcatatacaaactggtagagagttctgtgataattaggtaggcctaaagtgggaggtcattggaaggctaattttaactcacaaaaatctctttgtgattaggttcttagggctcagttttggctactcataaagtgggtaagtcagagagatgggaaattttggaaaattttggaatgttctgcaataagcatccaaggaaacccaggaatcctcttaatgatctcttaactactagcctgaaaagttttggatagcttataatctatcaggcataaaggattcatcttcttgggataaatcacatcataggtaacgaacttaaacaaaattctaacttctctttggaaattgtatgacctttctgagctaaaacaaagtagataggtagaataagtcttagaacttgctttgtctttagaacacagtcactggtcattcatattatctattgataagagtggaatcacagaaatttagggtccttgaaatcgttgtgaaaagtaggaaggtatctaagtaaatccaggggatatagtacaagtatgctgttgattttgcctagggtgtaccaacaagtatagagtattttaatacaaaggcactataacaaaaaagtagaacacaaatctgccactataagatatgcagcctcaaggactcagtggaaataagatggtatttgggtggggtatgataaacagcgattattctatttatggttctgaagtcctgaaaaaatctgctatctctgccactgggtttttgagcatggagtgtaaaagaattataagggctgttacaaagtttttagctattattttagtcctttagtcctttttaatctcttggttttagaagagattgtgcaagttgggtagcagttaaggtggataaatctgagtcttaaccgggtttatccataagaatgtcaagcacttccttgagatcttcaattttggcttgatttagattcaatagtagtcgtgaatcaatgtccagattatctatggtttctttatgagtgagggagtcagagactcaaggtctagaccatccagatagcatttaatttacagttccacccacgtagtaacttcctacctatcatgtgagtgaatatggtattacagagaaagaaagagtgtaatttagttaaagtccaagggtggctgtaatgggctgggatgtgaggaatatttgataattattgcagaaacctaccatgtgagtagtttattttcaatgaagaggttgtgtaatagtgataaggtttaaggttgatgatatttagcacccatatcagttaaaaaaatttgcagagttgtcatttaatatttagagaaagttttctttttgacttgaaagatgaaatgttttgtgcttgatacccaccggaagcaccttgatttgtcacttatttcatgttttgccctttgattctgagctaatgcaaaacaagtgttttccaatttccttactgcttacaggcgtctttatcaagagacttccttattccgggtttaatgtctgggataggaggatgtaattttatctctactttgattttttttaatgaaactctttcaaaatgtttagtgaggtgctagagatctgataatgggaataatattgctcattgtagtttttttttacatattaaatcctgtttttttggcttcagttcctttctgcaaaatggggaaagatgtgtgtgggctcatatctgcttcaaggtctactgagtccttcctaagggtattaaagagcctatcttcaatttctccaatggacacatcctttctttgcttgcaggactggattataaaacaatctattttcacagggaagactttaggggtagtctccaaaagaccttgtccaatatcttcagtttttctaaaattctttgtttcctgtaaaatttgaaactctttggtttcctgtggtcttttatgtcaccactgagactgacccattttgcctttttcatgtacttttttgcatctagggttatcactaaaatatgaactccttggtatagatttgggagccctggattctaacttcctaaagatgttttataatcctcgcaagttttcctctattctgcctgtgctttgaagagcctttgacggggtctctcatctcagagttagatggcttaaaatcaaccacagatgtttccctgttgtgagggtagtttaacatgaagaggtcattgagctttggggttttctggctgtctgaaagagaagaaaaattgttcagagggagagatgggggagagaataataataggataaagtctatttggtttgagttatgatttgttggtatctaaaacagagagagagttttttttttcttttgccctggctaacaaatttcataagaaagcagttttgaaatctgaattgcctttggatgtttctcagattaattaaaaatgtagactactggatgtttgaaattttgatctatttttattttaatgtactcttaaaaaattttgttcatagaaaaacttcccccaaagtggctgctataattgtaactcatctctgttgaaattatgccatttaaataagtatatgaatgtggattatcttataaacatatggaagaagaagtccagagggcgtttggaattagaatgagactggaggcataccctgaaagtgtggtaaaactctgaaaaaaatgttgcttatgaccccttgggtctctcaacctgatttctacattgtctaactgtagacctgaaggaatttgcagtttcttgggggtacataagatgttaataggggatttctcttagaaccagactgatgatcaagacaagattgaggaaaattgtcataggttttgataaggacctagggaaaaatttctccaaaggacagcaggctgagaagaaatcttacaaacttctccatccctggggctgtcttgagggatccacttacctgggtctctctcactctcttccctatgaacattccttatatatacacatgaagtggcaaagacaaaggcgaagagtagcatcactagtaataaggcagtttcaccaaagataaatttttttcaagtctgatcaaagtgttcctgaaaagagttccttacccttaggagacaaaataatctcagtatactgggagttcaatgaaaatatactggggctcagtccaatttgatttacttaatacactgttgcactaagagatagtcctgaccaggaagctaaaaggatatctgaggaggacaatgaattaaggttctgaattaaggttcttgtgcctaggctgcaaagaggtctcaatctttatggatcttggtgagatctccaagattgttcaatactgaattcctagaaatacaacctgaagaatattttgataaggcaaagctgagtttattcttaatgtggtaagagaaagcaatcccctaatagatattaataacattttggacaaggaaggacaaagttagaatatttatgagactttaaaggctcatttaagatgggtctttaaatgccagggcttgattaggatttggcgaggattatgataaaagagtttactgttggtggacacagcaaagtaaagatttggaggtgagggattcaaaaactcttagaatataagctattgtctgatgttttctactgatgagttaataagtttctaaggaagttcttgtaataaataataaacattattcacaacttttatttttctgagcaagaatttactggaatagtaaagtgaaaatagtgccagtgaaaatagtggaaaatttaaattggaggcaattagccatgagagtgtacatgattttgtttctcacagtgtcagttaacatttcccctctgtgcaaatccttcaatagtttacaatttgtttataataaatgtccgtagaatggcccacaaaactggacctggtcaagccactttctgtcacctcttacctcttagctactacttgctgttctggaaccactgggccagcttctgcaccagattctctcttggccccaagcatttttccaccgtctctctctctctgcttactcctctgccatcatcagttgtcaactaggctaacctggtacacttctctaagtatcaatatcactacaatgttgctctttacccctttccactattttcaacactgatcatgtaatataaaatattatttaatattttaaatgattatccatctccttgcactagaatgtaaacatgctgactgtagagatttttgtctttgtcttttactgctccaacaccaattctctgactttgaaggcaataaaaactgactttaaacctgaaaagaaagagctaaattgccttccagttctttgaagtaaaagtttatacttcaaaagaattgctctggaaagggagaaactgcaagagaaatttcaacttcttgcttctcaaagagaaaggcaaaattatataaaattttgaggaagggtggcatttaggttaaatttataataaacagtatagctgggttagatggaagcaaatggagttggtcagatggggttgatttgatcaaagccaagtggaaatgattggaaggattagagagcagaccagtacaagcagtgcttgctgatgtggacatttaagtgaaaactcattttgaccaattttgcagcttcctgagtatggggtgaggatatcctgttctttaggggataataagattttcagcttcttttgtacatgtgatgatgcctttaggcaagggtgatatttttcattctcatgaccaaagcacagaccataagtctgaacacagaacactatacatggtaatctaggtactctatttgcctttgtaggtgattgcaattttttccttatttaaaattttaagaccataaagaatacttgaaaagtaactttttaccaatcatttaaaaaatactgattaaatgataaaatcccttaaaaacacagttaatgcaaaagccacaaaaagaaatataaaatatagctttacatctgttaaagacactgaacacataattaaaatattcccaaacaacaatgctccatgctgaaatgttccactagtaaatttttacaaatatttaagggaaaaatgtataattttcattttctcaggatagctgacttctagtaactaaacatgacaaagaactataaaaattgaatttacagaacatggctactaggaatatagatccaagtagcctgaacacaataatagtaaatcaaattatgtgaatttttttttttttgagatggagtcttgctctcttgcccatgttggagtgcagtggcacgatctctgctcactacaaccttacaacctccacatcccaggttcaagtgatcctcctgcctcagccccactagtagctgggattacaggcacttgccaccatgccagtttaatttttgtatttttagtagagacagggttttgccatgctggccaggctggtcttgaactcccgacctcaggtgatccacctgcctcggcctcccaaagtgctgggattataggcatgagccaccgcacccagccaaaatatttttttaaaaggtcactgcattataatcatttggggtttacttgagaaatgaagattttttttttaaacattcaaaaaatcattcaacacttctggtttcagctctgatatgtgaggaacttgtaagttataattactgtccttataacaagataaagcagaacaaattgaaaaaaaaatcaattatttcctttaacccatcagagaactgaggcttcagggaaagttgccaccccaaagtctggggacaccgattgatacacagctgaaatttgcttagctggaacagaagccactggagccacaaattgataggaacatttaaatagcaatttagatgaatagctgggctgaatgtgggctagagtgaaaggaagaaactcctgggaacccccacatttttgtgggttctacctccagaacctcaacaatttctcatggtaaagatttaagaaagatcccctcctcctttggaaagggagagaagagtaatcattgtgaaatacacccagagcattcttcataacaaagacctaacctccaggggaaaaattttatctgagccatatctcagtaagggataaggggaagggcattcctttcatttcagccttctctagctttcctgttttaccaatcaggaaataaaaaacccacaattgtcaatagagatcagcacttcaaggaaatagattggaagcaaaagaaggagggaaaagagtagagaggtcaggtggagttgagggagaggttctgccactgaaggaatgtttgtgatggttgtaacaccaagacacaggcacacagagacttattcaaaagatcatagaacactctcccctatgtcttacgaccccaccagcagtgttctgtgtaatagtagattacagttgaaatagctgtaagacaccaattctctcagaggagtacttagggaagtccaaagtcaagagcagaaacaaaagacactagaggaatttggcatttctggtgcctctagtaacagcaaacattaaacaaagcccaattcctcatcagatttctgtaaatagcattctaaagctccatttacctcagtacttactaccagatacagttcaacaaaaaattacaatgcacatcctatgacaagaaaaaacagtctgaagagagaaagcaattagcagaaccagactcagaacaaagatgttggaattaataatagagatttaaaataactatgattaatatgttaaggactcttagacatgcaaaaatagattatataagcagagagatggaaactcaaaagaagcaagaggaaatgctagaaataaaaaacactataacataaatgaagaatgccttcaacaggctcgtaagtagattcagcacagccgaggaaagattcagtgatcttgaagttaggtcaatagaaattttgcaaactaaaatgcaaatacagaaaaagaaaagaatgaagaaaatgggacagaacatccaagaactgtggaacaatttttaaaggtgcaacatagatgtaatggggatactaaaagaatggagtatagagcataatatatgtttgaagtaaaaatggccaagaatttttcaaaattaataacagacaccaaaccacaggcccagaaatctcagagaacacaaaacagtaaaaatgcaaaaaaagcaaaaacaaaaacaataaaacctacaaatatcatattcaacctgcggaaagacaaacacagaaaaagaaatctttaaagaaggtagataaaacatcctcgtcttctcatcaggaaaaaaaatccgaaagtagtaatgtggtagtcaattatggcatatggatgtgtgaaaacaatggcagcaatgccaccagagataggaaaaaaaatggaaatcctctgttataaggcacctgcactaagcgtgaagtggtatggtgtaatttgaagatgggtttagattagttaaaaatgtatattgtagccagggtgacatagcaaaacccagtcttaactaacaatacaaaaattagccaggtgtggtggcacacatctgtagttccagctacttgggaggctgaggtgggaaagttgcttgagcccgggaggcagaggttgcagtgagccgagattgcacccctgtactccagcctgggtgatacagcaagaccctgtctcaaaacaaacaaacaaacagaaatgtatattgtaagttctagctcaaccagttaaacaaataagaaaagataattgatatgctaagaaaggagataaaatggaatcatgtaacatgatcaagtaaaagtagagaacacagtaaaatagaggtcttaaagaaatagtaatgcaatgactagaaagcagttgcaaacatggaatatattgatccaactgtataaataatcacttcagatgtgaattatctacattgaaaaacagaaactctcagaatggactaagacaagaccaaactaaatggctacaagaagcctactttaaaattaaagatttggatactctgaaagtaaagggatggagaaagatataacatgcttacagtaatcaaaagacagctggagtagctatattgattttcagacacagcagaattcagaacaaggaaggttaccaggcatgaaaagtggcaatacatagtgagaaagggccaattctacaagaatatctaaacgtgtatgcacctattaacagtgtcaagatatacatgaggtaaaagttgataaaactgaaaaaagaaatagataaaccctatttatagtcagaggttccaacatccctctggcatagacataaataagaatattgataacctgaacagcattatcagttaagttgtttgatgtttatagagtactccaacaacagaagaatttacatgaatatacattattccaaagtttacatgaaatattcatgaaaacatcatattatgtgccataaaacaaatttaaaagattataaatcatactaagtactcaggtcacaatgtaataaaactagaaaccaataaagaaagacatagctgggaaatctccaaatatttggaaactaaacaacaaacttgtatataatagacacatcaaagaacaagtcattagagaaattaaaaattattttgaactaattccagctggacaatactggttacaatttgtgggatgcagctaaagtagtgcttgcaaggaaatttttagcattaaatacattaaaaagaaaaagaccaataatcaatctgaccttccaccttagaaaaatacagaacagtttaagcaaacagaagaaccttaagcaaacagaagacaagaaataataaaagaataaaaatcaatgaaatttaaaacagaaaaacagtatggaaaaccaagaaaaccaaaagttgatttgtttaaaagattggtaacattgctaaacttctagtcaggctaagcaaagaaaagaaaaaagacaaatgaccaatatcaggagtaaaggaggggacatcagtattgatcccatggacgtgaaaaggataacagaatactaagaacaactctatgcctccagatttgataaatgaaatggaccaataccttgaagtaaactaccacaacctccaaaaggaaaaataggtaacctgaatagcaatatatctattaatgaaattgaaataataattaaccttcccccaaaatagcaccatgcccagagagttttactagtgatttttactaaacatttaaggaagatgcaataccagttctccaccattacttccagaaaatagaaacagagggaagacttcccaactcattacatcacaccatcattaccctaacataataaccagataaaaacattaaaagaaagaaaaactacagaccaatatctctcatgaagattgacgtaaaactccttgacaaaatattatcaaatcgaattcaacaatgtatagaaaaaattagtaccattatgtacattatgggatttattccaggtatgcaaggctctttgaacattcaaaattcagccaatgtagtagaccgtatcaatagcctacagaagaaaaattatattattatatcaatagatgcagtaaaagcatttcacaaaattgaatattcatgatttttaaaatctcagcaatctaggaatacaaggaaatttcctcaacttgatgaaaaaattctacaaaaaaccccatagctaatatcatactgaaatgtaagagactgtatgttaatttcaggagcaaggcgaggatgtcctccaattctatgcaacatcatactggaagtcttagctagtgcaacaagacaagaaaagggaatgaggcatacagattgtgatggaagaaataaaacagtctttactcaaggatgacatggagaaaatcccaaagaatccacaaaagaaaaacttggagctaataagtgagtataacaaagttaaaggatataaggttgatatacaaaaaccaattgcttacctataaaccagtaatagtctattgaaattagaaaaaaactataatagcaccataacaaaagcaaataaaacccttacttataaacctaaagaaaaacaggttcaggatctatatgtctatatgtagaagactataaaactttgataagagaaatcaaagaagatcaaaataaatgaacagatatatcctgtatccatagatagaagactcaatattataaaaatgtcagttcttcctaactttatagactcaattcaattctattcaaaatcccagcaggctattttgtagatgttgacaaagaataaccaacataacactgaagaagcacaaagacagaggagaaatactacctgattttaagacttttactagaagctgcagtaatcaagactttgtggtactggcaaaagaacagatacataagttaatagtacagaatagagagcccagaaatagacaccacacaaatataattaactgacctgtgtcagggaacaaagacaatccaatgcataaaagaatagtcttttcagttaatggtgctgcaacaaggagatgtctgtatgtgaaaaagtgaacctagacataggttttagatatttcacaaaaattaactcaaaatagaccatagaactaaatatgaaatgcaaagtgttaataattctaaaagaatacaagagaaaatgtatttgatcttgggttttgtgatggggaacaccaaagacacagaccatgaagggaaaaaaatggtaagcttttaaaatataagttctgtttggaaaaaggcacttaattaaaagataagccacagattgggggaaaatattttcaaagtacatatctaataaaggtattctagtcaactgtatagagaactcttaaaactcagcaataagaaaacaaatgaccaattaaaaaataggcaaaagatctgaacagacaccataccaaaaaacaaaaacaaatacaaatgataaatacacttatgtaaagatgcttaacattttctgtcactggagataaaaaataataaaataccactacacatgtactcatatacatgtacacagtacacatatacactacacacagtacacatgtattcccatgtaatagaatggctaaaatccatccaaagcctgatcatgccaacttctgttgaaaaggcaagcaacattaattggtgatggaaatgcaaaatagcacagccacttttgaagacagtttggcagtttcttagaaagctaaatgttgtcctgccatatatctagccactacgctccttggtatttacccaactaatctgaaaacttacgtccacataaatgccagcacatgaatattacagctttattcataatgaccaaaacctgaaattaactaaaatatcattcaataggtggatggataaactgtgatacatttatacaatagaatactatcaagcaataaaaaggattaacccatcaagccacacaaaaacatggataaatcatagatgcatattgctgagtaaaagaagccaatctgaaaagaatacatacaatattcttcatttttgtaacattctgggcaaggcaaaactatagatatcaatggttggcagggttcaggcgaaggggcagggatttaatagataaatcacagcaaatctattctgtatggtactgtaatagtgtatacattatactgtgcgtttgtcaaaacacagtgaactttaaagcacaaatgaaccttaatgtacacaaattttaaaaaatcatttaggagtttgggggatccaagatggaacacagtgtctgacaaaagaatccaggtgttttacaaatgtattagacaagcttacgaataatgttggggagaaaagataatgacttaagtaactttgaaaatgagtggaatctgttaagactagaggcaaagtgactgtacaggagcactgcacactatttgataaagttgttttctgtaggtgtatgagttagcaattctaaatcatgatacatatgtatattggaattgaacaattaagtaaatggttggcagatggtgtacattttcttattgttggaatgaaaagttacagacaagaagaaaagaatgatttgtgttgtaatggattagagttggaaacgtcagtgtaaacttatgtttagtttaatatgcagacagatggttacacatagaaatatagatgcatgtatttacatagttattgtacacaccctgtgtcaactgagaatgcttagaagcaatgacactctagtaacaatgggcacacctagaacccagcccttagtttctaataccattctccaatagaacaaatcagggatccttgtagaaatggctgattctaagactggttaggaaatgtacaagatgagcctggagcatcatatagtgccagagagtaaggaagtactaaaacaagaaccccacattgatgaaagtatatcaaagggactcaggaaccaaccaaaagagcttccagtggtcaaatctggaacaaatttttaaaaataaatagcataatattagattacaacccaaagtataaaatatccatgaatccatattgatgtaaataatcaaatgaataaataaactggggagaacatagattttttgtgcagaataatttcatatagtttttatagatacttttgcccttaaggaggttgaactccttactcgtcaagtgtgggaagaaagtcattaggcacattggtgactttctttcaaagagtacagggtggaaatgggggatggaagggaagagtaactgtgcaggggagaaacctgacaagcactatctctacatggtaatcaaggttaacatcagtagtgataaatcatgctgatagtatatacctttgatatgacgtgataaaaattgcactttacctctacagtcttcctcccaaaaacccataagatcagtatcattatgagaaaaatcatcaaacaaatcccacatgagatatactctacaaaatacttgactagttttgctcaaaactgtgaaggtcctcaaaaaggaaagcttgagaaagtgtgacagtcaagaagagcctaaatagacaagacaactaaatggaatatggcatcctatatgggatcctagaagagtaatagtacattatgtaaaactatggaaatctgaataaagtgggctttagttaataataatctatcaatattggttcgttgagtgtgacaaatgtgccatattaatacaagatgttaacaggaggggaaactgggtatagggtatttgggaactctgtttcagcttcactttttaaaaaatcttcaaatgtttacttcaaaaatgaattcaaaatcactcaatgtaaatcactatggtaacataagagagaagaaaagttatatgatcatctcaaaagagaaaaagcatttgataaaatataaaaactattctttataaatctctttattggaactacgaatttatgggaactaaaaattgaaaaaaatttaatgagataaagggtatttacaaaataaattaattgtaaaattattgacagtggagatagagaaagcttttttatgagattgggaataaaagaggattttttttcatcatttctattcattactatactggatgtcctaactaggggagtagagtcatagaataaggattggaaatggaaaggtataagtttcattatttactgacaagaaacaagtctgaacatgatcaattaaaattaggaagttaattgagcaagattgctgggttaaaaagcagataactaaaatgtatttctatgtaaaatgacaaatgaaaaatgaagtttttaaaagataacatttttgggaacatcagaaacatcaattccataggaaaaaattcacacaaaatattatgaaacattatggaaaggaagcaagtaataccttacaaatggagggatataatatattcacagtggcaaattcaattacatatactatacatgttaattctcccccaaattcacttaaagatcccaacgtaagagcattctaaatctgaatgccatttattaaatgttcaatctaatttcaagaattatatatgacacaaaaagtcaagaagagccaagatagtcttgatgaagatgacaattttgcatgagttacatggccaaaatttaaggcctactattgcaaggttacagttactgacaaaagacagaaaactagcctaatggagcaaaatagagactccactccacaagcagatcaatagatatatgattacttgctttatgataaaagtgccactcctgcatgatgaggaaagaatggtttgttcaatagttagtgctggatatcaatacataaaaaagtgaattccttttcaaaccatacagatccatcatttctaggtgtaatgttggtctattcatgaaaggcaaaacagtaaagcttcttgagcatagcataacataggagggtgtcatcataatttggcagaaagtgaaaaataccaataacactaagcataaaggaaaatattgatgaattagtctgcatccaaattaaaatttttatttctcaaagtatataatcagtgaagaagcatcgtataaaagatacaacttgtacatgtcaaaaagttagaaaacacttaaatgggtacttcacaaaagaggatatctgaatggccaataagcctatgaaaaggtattcaaggtcattagccatgagaaaaataattcagacaacaatcagataaacatcttccagtatatctagacagtccccaatttataatggtttgatttatgatttttccactttatgatgttgtgaaagtggtatgcattcagtagaaaccataccttggattttgaattttcatttcccgggctagccactggcagtatgatactctagtgaggctaggcagcagcagtgagccatagctcctagcagtcatgcagttatgaaggtaaacaaccaatacttcatcgcgtactgtgctgccaccattttgacccactgtaggctaatgtaagtgttctgagcacatttaaggtaggctaggcaaagctatgatgttcagtacattaggtgtactaaaagcattttttatttacagtgtttttaacttatagtaggtttattaggaggtaactccttcataaatcaaggatcatctgtttaaaatttgaaagtgtgtgttttttagaattctcttagtattcactgaagttgaatggaggcaacatactctcaggtatatggttaacaaaaattcatgcatgattgacccaaaatatgtatacatgaatgcttatcatggtgccatatctaatagcaaaaattgaaaacaaagtgcccaggaggagttgaaggataagtaaaccttaaaatatgcacatattctctcaaggaacgtggatagtattgtgactgattcttctccatgtgtgatccacatagatgataagatcatcatgagaagaacttaattttatacttgagctttgctttgactgaaagatgagaaattttgtgattattggtatcatctctatgatgtcatattacctagattcacatattcttaactccattaaaatagaaattatatttgtgggcggggaacttattttcatccatctctgtttccttccaattgagcaattccttattttatgttaacctgattttagtggttcattgccataattcttagaaattatatctcattttttcctgtgattttactgtattgaagtaaatctggttggcaggatatacaatattacatgaatgaaatttgcctttggtaactgagaaagttcaaatagaccttggttctagcgaagacttgtttctaaggaatttagattcattctttcagacagtatgaatatcattatggggtcttcttcatgagttatgtatgtgatgggattcttgtaagattttcaccttttacctgagcttgccttgactgaaagttgagaaaattttgtgattcattggtataatttctacagtgcaatatttatttggatctaagcatgcaagtaaaaaaattcatccctgttatagtatttcaggtttgcagtacgttatgacatttgtagatcattgatggactatgaatattcaagggacctggcaattgtacccaggggattgagatccagatacttgtttgtttgcccatagatataaaattaggagcttcctgatatctaatttacttttttaggaataacacccatgagatacagttctcatctactgccctactcctgtccttagataaataacaccggaagaagaagactctctggcctcttacatcagggacacatgaaaagccacactgaatatgtatgaactccaatatactttcacagaagggtttaaggatgccatccctggttataatttttaggaccaaatatatatatatatacacacatacacacacatttaggatagatatatatttaggatatataggataaatatatatatttagtgccatggtttgggtcatgaggaggtttgatgacataaaaattatgctcataagtattatgctgagacccattcttgggaggagatgtgggggtgtcctaggctgtgcaaaacatagctatggaaacagaagttattaagagaaaagaacaagcagtcagtgagaatttagataagagactgtaatagaataaaagtatcagattagtgaatggttgtcctagtaatttggaagaaaaggaataaaaaatggagtcagactactaaatggcaaaaataaagacttgaagaacttaattttatacctgagctttgctttgattgaaagttgagaaatcttgtgatttgtcggtatcatcatctcaaatcaacttatttttcatctcaacatgaagaatatcagctctagccttttggaatttcagcaactcagatgcttgttagaacttatccaggactgcttgcaggacccaaaatactaataatccatatgcctttttttccagctgaaattagctgtcttaagagttgtttttcagtgctctgaggatatccacaaatatatcccaaggcactctgaagtgtgttttcaatctttggccctgcacactggggatgcccactggatgttgcatggagtgttgcctccagttgactttgatagacacaataaacaccacgtgagagccccctcatgaaggagggctgaggacttggagtccaattctccacctcccctgacagataggctattcaatgccttgggaatccgacatgaaggactgcttatagcagtccttgaaaactttctacagaatgtgaactgggagaagctaaatgctgtactcacaagctgggtgacttctccattgatttttaccatagctcactgaaacattttctaaattaacaggtataaattcacagacagatcagaatagatccttggtcctttccatttttctggcacttttgttgccaggaattcaaatacaactaagagaaaaagtgggtagctagcaagaacagatagtttctcaaatattagtggcagtaacccaactttgagaaaatatggagaaagagaagaaaaaacccttaagactgcagtgttagctgcccagttacaattattcacaaagtgagcaaatacttatttgggccaccaataaataagagggcacaagctaacgggaaattaatacgtcactcatgtaaaaagtcaacacattagaaaaaggaatcttggatgagattgagaaagatgcaagggataaaacctgacaagctttacaacctccttgaggaggtcttccctactctgtaaaatcagacagaaaatcattggcaaatggagcaaagcatgggcaaaactgatataatgaggaaacagagctgggaaaggataaatttatgtgtctgtttctgtttcctatcttttaatccttttttaccctttcttctggatactggagcaacgtattctgcaatttctacaggccttttctgttttatcctaaactaggaaaatatccagatataagtatttctggactatctgctacctcttctttctcctctgaggttttcatgcaaataggcgaggtcctatttgcataaaataggaagaatatgccttgtctcctaatatgcccaataatcttttaagaaagggcctgctgtgtaaaccaagggctatgatcttctgtactctgaagagagtgcttttggagcttctgggatgcaaggtatctacattgctaaatatgtgctttctgaaacaaaagatggctgtgggagagtaggagtctcactcaatgctggagaagcactcccaagttacagaaaataaacccatatctatgagtcctaggaacaaatgataaagatttaacaaaagagatcaataccattgttgtaacttacaacagagaaaaaccttggccatgtatagaacattttctctatttttacctcaaatatgatgtaattagaaaaattttaaaaaacgtggcatagttaaaaaaaaatggcacattcacttcataatgcttccatattgcctgtgggaaagttaggaaaacttgacagggaaggtcaaactgtttatagatttatgcatgatcttagagaaacaagttgtgattcctctgacacttgtaattcccagccttgccactgttttaatatctgttcctgagttatctaagtatttttctgtcatggatttatgttcaatgttttgttctccatgtttagctggggagtcgaggttcctgtttgagtttacctgtggagcgggaggctttcaatatttgtggcaacggatcttcctggaattcagagagtcacctactccattctctgggcatttataagaaaatataaagaatattcctcacattaggattccatactaattgttattgatagctgctaataacttacatgctagtaaagaagacattttagctttactaaatttcttagactcccaggacgtaaaacctcgctagctaagttgcaatattaccaactgaagtaaaatatttgggatctgtgttattggcagatggaaggtggttgcatcttgaagtcagcctaatatacaaatgaaacaacatgccaaaaaaaaacttcaccgattttgaggattaattgtagatctttgcgttttatgaaaaggctaagcctctcactgagatgttacatgaaacatcactagaactctttattaaagtcaaaataaggctgaagaagtcttttatgcccttaaaatagctgctatttcttcacttgtattacttttttaaccttgttaaaaaaggagttctaccttttctgtcttgagattaagggttactccaaaattaggccttgattataggcacattgcttactttcccaggttcttgtattttgtctctctggaaatgcgatgatatttataaggtacagtggcaaccactcccctgattaaaaaggctcattcagtccttgactctgagaaatttaacttacttacaggtacttcatgttgttactgctattttacaagttcataagacacaacacttgtcagtatgctgtcaaacgagctaagaacaagtcttattgtgtgatcctaatgctattctaggaaggtgtaaccttttgacagctattctgtggccagatcttgacagaataagttgaacttgactgtctcagagtgattgaggaagacactggagcatggtctaatttttgtaatattcctattcccaatgttgactgaatattcatgaatatattctgtgtgaaagacccacaaaggaatataaaagcatgttctacggtaatcaaccctcatgaagcttagaggcttctgtttttcgaaacataaaatcagcccaagtggcagaattgtagttattataccagctgttaaattagccaccagttataaagcagatatctatactggtaataactatatgtttgtggtctgttatgtgactagccaactttggaagaatagatgctaacgtcaataggaactaaaatattacatgagaagctaatttctgatttagtagagtcattcaaacttctctaacagatttatgtaatttattgtagagctcacagtggaaaacaagattaactctttaaaaagaaattaatttgcagacctagctgtgaagggcttctgacgtttagactggggaaatcaaacctctatcacttctgtccaaaacctcctattcataatttcagaaatagccaactctcttaagaattagaaaattaggaatgaaggagaactaagatgaacaccataggaaaatgagaattacataatgaaatctttcctttattccgattgttatatgattgagtggctttttcatgccaccaacaagttcgttcaagcaaaaggaatatgctgacaacttgaaatctttgtaatagcatcatataattcaggaaataatatgaagatatgctctttgtcagaaaaattctttccttacctaaaataagtcaagaaagcctactaaggcccatgatacctaggatctgctggcacaagaactttatagaacttccacctttagaagatagtaaatatttttaccagtgttgtgtattggtgtctggataggctaaagcagatgctcaaacagtgatcaagctcttactgaatcatatcatctcaaccactggaattcctgaatatctggaattcagtaggggaatcattctgtatttgtgggaattcgggaattttgtaatactctacaaataccaataatttacctacctgttatccccagtcttctgaacaagtggaatgagtgaaccacataccctaaagaattatttagctgaattatttagctaagttatgtaaaaccttaccatccgtttcatttaaaataagattaaatccctctagcaagcccaacattactccctttgagtttggaaggtctactaatcttgggcttaagcctaaccctttctctgatacaatggaaaatcctcatgaccatatatgatacttaaagagtttgtgggtttccctaggctcaccttgccaacatgtggccagatgctgaaaaagccgcctggggaagtgtgtcattgatattgaacaggagattcagtctatatcaaagtgttctgatgacagactgtgaccacactggacagaaccctatcaagtgtggttgagaattcatagtgctatcaagatgaaggagaaacccaagtggatacacgcttcacatgtgagaccaacatccaccatcgagtggggtataattcccatttaggaccttaaggataaattctctagatagtaaccttgaataatatgcaagctaaagagaaaaacttatttgatagacagcaggagagatagactgttttgttattaatacgttcttcttaattattttgaccattataattttgatacttagtttgtattaattttgatacttagtttgtatcaattgaacataaagcttattattagtctttcttttaaaagttagtatctcaacctcaaggaattttgtggtaattaaaaattgtcctgaatatgagatcaggacttaagaaacccctttctttgtcataatacttcaaactcaccaactggatgatttaaattcagaagacatgaaaaatttcaaatcttcccactgattagtcaatattacaaaaatcttaaatatcatcaccctttgtgttattgaagatactgatgagaagaaatttttaactaattaagttgaacgtaattatattcaaattgaaagtccctgaagggtatcacaaaactccaacaactctgtatcttttttttttttgagcagagtttcaccttattgcccaggctagagtgcaatggcacgatcttggctcaccacaacctctgcctcccaggttcaagcgattctcctgcctcagcctcctgagtagctgggattatagacatgcaccaccatgcctggctaattttgtattttttgtagagatggggtttctccatgttggtcaggatggtctcaaacttccaacctcaggtgatccacccgcctttgactcccaaagtgctgggattacaggtgtaagccaccacgcccggcccaactctagatcttaaatagccatgggggtccaatttaataaagcttaaatagacacacagatgagaaaatatcccagcccaaatggtgagggttagtttcttcaaaacccccaaaacgtatcatcacctaaaaatgagcttaccctgtttagaacctggcagtctccagtccccatacttacaaactcgaggataattaaatggtctgtatcatttaatattacaatagctaatgtgagtaaactgaattctacttgtacatgataggctttaccactatgaaatgtttttacacagggactaaaatggcactatgatcaaactgaaagagatttctttttttaatagatggggtctggctttgttgcctacactggagtgcagtagcacaatcatagctgtctatcgcctgtaactcctgggctcaagggcttcctccgtctcagcttcctgagtagctgggactacagggacatgccaccatgcctgcctatttttttttgtagagtcagggtcttgctcaggctggtttcgaacttctggcctcaagtgatcctgctgcctcggccttccgaagcactgggttcgcagacataagccaccatacctggccagagattattaaatacagtattagggggaataaaactaggactacaattgtaaactcttctgatatagaaacaattactgataaacagtgcattggacaatttgcagaaagatgcaaacatgatagaatcaaaatctaaacaagatatgacaaagaaaaacaaaaatggaattgggaaagcatttggaattggacatctggtaataaaattctattgcaaaaaaatatatagtaaagaattttcagaagccttcacttgcattagtgcacaaccactggttattcaacaactacaatgtatacttgctggtactgaagtacaagattatacctactcagacaaacaattaggtattggacatactactgtctatgtagagattaaatgatagtgtaaaaaggttgatcatattataggtaaaagagctgaaatctggcattgcagattgaaatttctgaaaactgaaataataaaactaatttcactaaagtatgtacattttcttatttacatagtttataatgtgttatataattcatgaatcttcaaaagaaatatactgagctattcaataaaaatttacattacagctttaggccaccaagccccatctattgattatgtacttggtgtaaattggcggggggaacaaaacaagagtgaaaactgagcctcaaaatacaaagcatgtagcaaaacagactactaaaattattctcaatttctaagcccattatatgatgcaggagaattcttatgtgtaggtaataaagaatctgttcaaatatgcatcagtggtatgacagtttcaaataacccactgaactaggaaatattcaccaccaaggaggtcaggtatactgatttggtcaacctggatattgacatgggatgttcttacggattgacagctccacttgatgctatcctatcacaaaatattattacctgatgttgatataattaacaagtcaatacaaaaagtaaggtctctctacaagacaagactaacatctctgtaatataaatgggactctgagtgtaatagatttagggtttctgcaagaattttgaaagttaaggatccaacgcctgtaatcccagcactttgggaggccgagacgggtggatcacgaggtcaagagattgagaccatcctggccaacatggtgaaaccccgtctctaataaaaatacaaaaaaaaaaaaaaaatagctggacatggtggcacacacctgtaatccccgctactcgggaggctgaggcaggagaatcgcgtgaaccagggaggcagaggttgcagtgagccgagatcgtaccactgcactctggcctggcaacagagcgagactctgtctcaaaaaaacaggaaagcaaaagaaaaagttaaggatcctaccaacaaaattggaatatgagactgaggaaattcctattccagctaaacccagaattgattatgttgatgaacacatgaatttcatgtgtgtgaaaacatatgaactcctcattgtcagtctaatgagagtgaaaacaacacatcgaagatgcggggagacgacaatacagagtgggctcataactgcattctagatactgggattactttccattaaggtatataattttagaatatctcacaaatagcccatgcaaaatcctgcggaaaggcaaccataaatatagagagaatatgtaaaaaagtggcatggtctagtatatgccaaacaaggcaagggtatacaaaaacctcaaggtcccagtatgacaaatcatgcttgtattgcacacccattaaaaagtcttctaaaaagtttttttaatggtgtgcaggcaggtttattcagaaaaagctcggattcatacttgtaaaagtctgagaaaagcattaaaatgctattatgatacagttgacccaaacaacacaggtttgagctgtgcaggtccacttatctgtggattttcttctacctctgccactgagacagaaagacaaactcctcctgctcctcagactactcagcatgaagatgaggatgaagacctttaggatgattcacttcttcctaatgaatagtgaatgtattacttccttaataacgtttttttttctctagcttcttgtaagaatacagtatataatatatgcaacacaaaaaatacgtgttaatcaactgctttatgttatcagtaaggcttccagtcaatgggagactaactactaattaagtttttggggagtcaagttatatgcagattctccactgagcaaatgttcagcactcttaactcctgtggtgttcaagtgtcaactgtatatatgtttaagagttattgtttacccagtagatcaagccaagaccaagttaggtttatgtgtttttggcttaacctaagaaaatgttcagactaaagcagtccatcaatagaacagactgccttttaaaccagggaacaacttgtctttgtaggtattttaggtatatgaatgaccatatgtgatctgctttgggtcatctatggtcccttccaacttaaaacttctctattcatgaacattgcataactgaattgtggatttcatataaataatatcttgttgcctactttaggtttgaaatgttttccttctcagttgcatagatatgtatagcaccatccccactatgaactctcatgtagaaaataccagattctaaagtcatctgtgaggctaaatgtcagacttaggcacttccacataatgctgcaaaaagcaacagcttaaaggtattacttgctcaacatgtcattccaaacacatacactatgattagcagctgaatttaacagtatctttccactttgaaaaacactttatatacctttacaaagaagccatagtatctcagggtagaaaaactcaacaggtagaaaacatggccttctcttagaaatgagctacgtaattttgagtacttatctcaaaatcattgcagaaacatatctagtgcttatggaaaaagaatcaaaagatctttttttttagctaaagattttgagtttttcttgtgacatttaagtcttttaatgtatgctgatttttatgattatctaactgtttcataatggttattcttgcctccatgaaagggaagactagaacaaaaacctgacaagaacaagttctagctccatcaccgacttactgagtgaccctaggcaaatcatgtgggctctttcttgtgttttaagttttacctccaatgaagtaactgcctcagactagctgtgaagctctcataaagtgatggatttgaaaatgccttgcaaagaatgagcagttaatacatagaaagtttcatgtacttccgtatattgcatgatgcccacccagggttaggttgataacagttgttgatccaataatgaaagaaataaaaagaactctttaaaataacgaagtaaaatagctaattttcctgttgtagttttaaaaattatataaactatataactaaacatatttatgtttattatatataatatgatatgcaattacataagacattattatataatgtttttatataatgcttaagtaattaaacaattatatttaaatataagttatactttccttccccagataagacaaagaacctgtttacttctctgagggatttattggttcctgtgaaatctgtggaggccgctaacactccatagccagagaatgacaacatatgattttcttttcagtcttgtagtatccacagtagtgatgtctgtccatgtacaagtgtctgtccaggacatccattaaattccatgcctgctctgtgtgttatgagggcagggacagaagacagattcactggtggtactttcaaacaatgtggtaggccttccttttggggtctgccatgacaatgataccccaggcggcaatgctaaggcccatgaccatcttcataatggtccatggacccggggggtatcccatcttcatgggcttctgtgccacccagtacacatacccgcctgcccccatcagccgcaacccagaaagcacgtgacagctccagcaggtctccaacaggtggtgttctgctggtgaggtcggcgatccgggtgtagctggggttgcaggcttggcaggcacggcggcggtatcgggaggcacagcgatcttgagggactcaaaaggctgggacaactgagaccccgtgttctggaactcggcctccctaaaaattatgttttaaaaaatacatagaatcggtaagatgaggaaaaagcataaaacggtcaaaaacactgggataattcaaggttcattttgacaatggtaatacaaatagaaaaactgacaaaaaagaaaatacatcttacattagaaaacatacaagagtagttgtatacaaacgaagacacgtaccaaaaataagttacaaaatatgaatgcatatacataaaaaatgtagtttcaaacaattcaaaagtaaaatgatgcaagacattaaaatattcacaaacacgctcgaaaaataagagctgacgcccaaattagaccagttcaacggaagtgtggggtgtggttggggatccgccgcagaaatcacgtggcgcccaggccaaggctgcaatttcccatgctgcttggagaagacgcctgggagggctcccaccatgcccaggggcaggctatgtgactgcccggtctgcagctgtaagtggtttctgggccagtctctttgtctggtcatgacctggttggtggccctagcttgtgccgagtggtcccggagtggcccagggggttgtgtgtggggagccagcgtgggcagcggaggtgctccctggggcctgcagtagggcacagcctctgcatcttgtgtgagcccagtgacccgcctgtcctgtccttccagggttgggtggcagggagggccaagggtgccctgcgtccgtgacgggtcagcgtttccagcaaatgggtccatggagggagagcctagctgagccggcgggctctaccaccttcatgaggttctgtttggacacctgtcctactcctgttcccccagatggtgaccatggaggaagacttgtgttgggcccaatggccctcggccagtgtccgtctgccaggtgccagcccccggtgcgctgaagctcaggccattcctgatgccctggcctcctgcactgagctgtggtgagcccatccgggtcctgctggatacatgggcggggaggggggtgccctgggttgtgttgatgatgagaaccttatattatcctgaagagaggtgatgacttaaaaatcatgctcaataggattacgctgaggcccagcctaggtgagaattttggaagaggatgctgggatccagaggcccccgacggggccactgtatttcgggctgcagacctagaggccctgaagggcatctgaaggtggcccaagcctatctctgagcaaccccgtgaggcagtcaaggatccctgtgtgggcataggctggggctctggttccctaggggcagggcatgtgggtggctcctccctgacccccattctcccctgtgtctttcagtgagctcttctgcccaggcaggccccctggcattgaccggcataggtgagtggatcctgctggggtcatgggccatgagccaggctgctggggtcgccaagggtcagcctttgggacaggagggtttccttagggagccaacctgaatccccactggggagggctaggttctccaggagggcagcttccttgggagtctgacccaaggaggatatcttctctaaagccctgcagtggtgagggtggtccaggcagcaaagggttccttcaaccccacccaggacagcgcccagctgagactcagtgtgcaggtctggccatgaggactgcccaggtcacataagggggtccataggagctccggggcaccacaggggtcacacaggagctctccttccccagagaggggtgagcgattgggcctatggggtcaggcctttggagatcaaggattgggccccacccatgaacctgaatgggactgagcctttgagcaatggaccatcccagtggtgcctcggagcctagtcgggggtgatgtggcttcaagggggttgggtcaaggctgagctctggccggtgcctggtagtgctgcaggctggccctgggactcgctggctttgggcaaaggggccagcccgtgtcccactggaggtcaccccttccctgtgggcaactagcaggaagggtggcatccttagctgggaaggcccactgtcgagggtcctgtccagggaatttgcctcccaggcttcttctgatccacggactcacctccagggtggtggggtcttgggcccgaggaaaggagaagataccctgtgttccccagttggctgagtgtggcttggctctgtgtttgggaggtgtgtagggtatgaatggggacccaccagagaacacacatggcccagggccccaggttatgatttcccatgcacacttggagagaactctgggtgagtgccctccactcccaggcacaggctatgcaactgccaggtctgcagtggcatgtggcttccaggtcagcctccttggttggccatgagcaggttggttgccctgtcctgtgcccagtggtcttggagtggcccaggggtcctgcaggggagctggtgtgggtagtggaggtgcttgtggggcctgcaatagagcgcagcctaggtgccttgcacgagctcagtgacccacctgccctgtcctagtcctagctcagtgacccacccccgctttgcagtgatggggagtaccaagcgtctcctgcgtctgtgatgggtcagtgttcccatcacatgggtccatggagggagagcatgcatgagctggcaccacccaccaccttcccactatggaggcgtgaggccatgtttggacacatgtcttcttgtccccccagacagtgagcctggaggaagacttgccctggtcccactgtccctgggccagtgtccatcagccaggtgcccagaccccagtgcgctgaagctcagccctccctggcactctggtctcctgcactgagctgtggtgagcacatccaggtcctgctggatgtttgcatggggaggggctttccccgggttgggtcgatgatgagaagcttctgttttcttgaagagaggtgatgacttaaaaatcatgctcaataggattatgctgaggcccagcctaggtgagaattttggaagaggatgctgggatccccggcaggagggattttgggctggagacctggaggccctgaagggtatctgcaggggccccatccctgtctctgcacttgtctgtgaggcagcccagtttccctgtgtgggcttcgtgtcagtgctctggttccctggagcagggcacgtgggtggctcatccctgaagtcacgttctccctttgtgtctttcagtgagctcttccgcccatgagggccccctggccttgagcagcataggtgagcggatcctgctgggctcatggaccaggccacatggggtcactgagggtcagccttcaggacaggagggattcctcagggagacaacctgaatccccactggtgagggattggttctccaggagaaccacctccttgggaatctgacccaaggaggacaccttccctgaagccctgcaggagtgacagtggtccaggcaggaaagggttccattagtcccatgcagggcagctcccagctgagacttggtgctagggtctggcctcgaggactgcccaggccacatgaggcagggtctcaggctgctatttccagtgcatgcttggagagggagcctgggtaggccccctccctgtgcaggggcaggctgtgcatctgctggggctgcagcggtgcctgccttcaggaccagcctccttggttggcttgagctggatagtggccttggccccacccaggggtcatggtgcagcccaggaattgcaggggagctggcatggggagtggaggtgctccaggggcttgcagtagggcacagcctgggcatcttgcttgagcccagtgaccagcctgccctgttttccagggttcagtggcagggaggaccaagggtcccccacgtccatgactatcactgtttcacatggatcccatcaggtgggtccatggagggagagcatgtgtgagtcagcaccccctgcctcctttcccgcatggaggcatgaggttctgttcggacacttttccctgtctctccagatggtgaccctgaaggaggacttgtgttgggcccaatggcctggggccagtgtctgtcagccaggtgcccagcccctggcgtgctgaagtttgggcccttcctggtgccctgttctatcgggggaacccgcccccaataattcaacgtaggtccttttctattttccctaagtgtcggccggtctgagaaataaagggaaagagtacaaaagaaagaaattttaaagctgggtgtccgggggagacatcacatgtcggcaggttccatgatgccacccaagctgcaaaaccagcaagtttttattagtgattttcaaaggggagggagtgtacaaatagggtgtgggtcacagaaatcacatgcttcacaaggcaataaaatatcagaaggcaaatgagggcagagcaccagggccaaattgaaattgctaatgaagtttcgggcacgcattgtcattgataacatcttatcaggagacagggtttgagagcagacaaccggtctgaccaaaatttattaggcaggaatttcctcgtcctaataggcctaggagcgcttcgggagaccagggcttatttcatcccttatctacaactgtataagacagacattcccagagcggccattttagagacctccccctaggaaggcattctctttctcagggttgttccttgctgagaaaaataattcagcaatatttctcctattcgcttttgtaagaagagaaatatggctctgttccgcccggctctcaggcagtcaggcctgatggttgtctcccttgttccctgaacatcgctgttatcctgttcttttttcaaggtgcccagatttcatattgtttaaacacacatgttttacgaacaatttgtgcagtgaacgcaatcatcacagggtcctgaggcgaaatacatcctcagcttacgaagatgacgggattaagagattaaagtaaagacaggcataggaaataataagagtattgatttgggaagtgataaatgtccatgaaatcttcacaatttgtgttcttctgccatggcttcagcaggtccctccgtttggggtccctgacttccctcaacactggtctcttccactgagccttggtgagcccatctaggtcctactggatgcatgtgtggggaggggggtgccctgggttgggtcaatgatgagaaccttatattgtcctgaagagaggtgatgacttaaaaatcatgcttagtaggattacgctgaggcctagcctaggtgagaatgttggaagaggatactggatgctgaggtccctggctgagctactgtattttgggatggagatctggtgactctaagggcacctgaagggccagaccctgtctctatgaggcagcccaggctccctgtgcaggcttgctgttggcactctggttccctggggtgggacatattggtggctcctccctgagccctgttctccccttgtgtctttcagtgagctcttccaccaaggagggccccctggcattgactggcataggtgagtggatcctgctggtgtcatgggccatgggccaggccacgtggggtcaccaagggtcagccttcaggaaagaagggtttcctcagggagccaaactgaatccccactgggaagagatgggttctccaggagggcggcttcctgggaaacaggaaccaaggaggacgccttccctgaagccctgcaggggtgacggtggtccaggcaggaaagggttccttcaattccacccagggcagctcccagctgagtctcggtgctcgcgtctggactgccctgactatgtggggggccacaggggctctggggtgccttgggggtcacacaggtgctctttgtccctggagaaaggtgggtgatcaggcccatggagttgagcagtggagattcaaggattgcacctgacacatggtcctgaatggaacccaccctgttgagcaatgggccatcccatgggcctcttcaagcctgaagaggggcggtgctgtttcactgggtttaggtcaaggctgagctctggccggtgcctggtggtgctgcagtctagctgttggactcgtgggctttgggccagtggggcagcctgcatccctctggaagtcaccccttccctgtggctggaagttaccccttcccagtgggcgaatgtggggaagggtcacctcctgaagtgagaaggcccactattgagggtcctgtcctggcaatttgctgcccatgctgcttctgagccatggagacacctccagtgtggtgggatcttgggcccaaggaagggagaagacactgtgccccccgattagctgagtgtggccaggctgtgtgtttatgaggtgtgaggggcatggatggaaactcaccagagaaagcatgtggccctgggaccccaggtcgtggtttccagtatgtgcccagatacagcacatgggtgggtgcccaccatgcacagggactggctatgtgactgccagctgtgcagcagcatcaggcatatgggccagcctccttggttgacaatgaactggttgctggccctggcctgtgcccagtagtcctggggtgaccctggtgtcatacaggggagctggcatgtgtagtggaggtgcttgtggggcttgcagtagggcacagccctggcttctagcctgagcccagtgacctgcctgtcctatcctttcggtgttcagtggcggagagagcattgggtgccctgcatccatgatgggtaagtattccacatggatctcatcacatgggtccatggaaggtgagcatccctgagctggcacaccacaccttctgtccacatggaggggtgaggttgtgtttgggcacttgtcctcttcctgttccttgagatggtgaccccagaggaggacatgcgttgggcccgctgtccctggccagtggccatcagccaagtgcctagcccctattgcactgaaactcgggcccttcctgtcaccttggtctcctgcgttgagcttgggtgagcccatccgggtgccactggatgcctaggcagggaggggggtgccctgggttgggtcgatgatgagaactttatattgttctgaagagaggtgatgacttaaaaatcatgctcaataggattacgctgaggcccagcctaggtgagaattttggaaggggacactagaatcccgaggtccccagcagggctgctgtattttaggctggatacctcgaggccctgaagggcacctcatggaggggcccaatcctgtctgtgctcctctattaggcacaccagactttctgtgtgggcttggtgtccacgctcagcttccctggggtgggacacgttggcggctcctccgtgagccccattatcctctgtgtctttcagtgagctcttccccccagcagacccctgggattgacgagcataggtgagtggagactgctggtgtcatgggccatgagccaagctgcgtggggtccccaagggtcagccctcgggccacctgggtttcctcaggagctgatctgaatcccaactggggatgtgttctccaggagggcagcttccttgggaatcagacataaggaggaggccttctctgaagccccgcaggggtggcagttgtccaggcaggaaagggtttcctcagccccacgcagggcagtgctcagctcagacttggtgcttgggtcaggcctctaacatggccaggccacatgaggggggcaacaagggctccggggagccaagggcatctcacgggggctctccaaccctggagaagggtgggtgattcggtccatggggtcaggccatggagattcatggattgcagcaaacccaggaccctcaatgggactgaccctataagcagtgggccctcccagtggcacctctttgagccatttgtggggcggcgctgtttctctgaggttgggtcaagactagctctggccagtgcctgatggtggtgcaatccactcctgggactcgtgggctctgggccaaggctgcagcccatgtcccgctgggggtcaccccttcattgtgggcgagtggcagtaatggcctcctgagttgggaaggcccgcagtggaaggacctttcctggaaatttgcagtccaggctgcttctcagccattaggacaactccagcgggttggggggcaggggcgggtcttaggcccaaagaaaggagaagataccatatgtctcccggttggctgagtgtggccctgctgtgtgtgtgggaggtgttgtgtggggcatggattgggacacaccagagaaagcttgtggccctggagccccaggctgcgatttccagtgcaccttgaggaaaggagggtgggtgccctccatgcacagggcagactgtgcaactgccaggtaggcaacagcacgtggtgtccgggccagggtccttggtttgctgtgagctctttggtgtccgtggcccctacccaaggatccagataccacccggggtcatgcaggggagctagcatgggcaatggaggtgctcaaggggcctgcagtagggcacagcccaggtgtcttgcctgagcccaggaacccacctgccctgtccttccatggttcagtggctgggagagcaaagggttccgctgatctatgacacatcagtgtttcccatggatcccatcacatgggtccacggagagagagcatgtgtgagctggcacccccaaccccattccctgtatggaggcgtgagcccatggttggacacatgtcctcctcctgtccccccagatggtgactgtggaagaagacttgctttgggaccgctggccccaggccagtggttgtcatccaggtgcccagcccttggtgcacttgagctcaagcccttcctggtgccctggcctcctgccctaagctgtggtgagcccatccaggtcccactggatgcatgcatggggaggagggtgccctgggttggatcgatgatgagaaccttatattgtcctgaagagaggtgatgacttaaaaatcatgctcaataggattacgctgaggcccagccttggtgagaattttggaagaggatgctgagatcccaaggtctctggcagggccactgtattttgggctggagacctggaggccctgaagggcatcttaggggtgcccgaccccatctctgcgctcctccttgaggcagcccaggctcccttgcgggcttggtgtcagccctccagttccctggggttgaggcacattggaggctccttcctgagcccccattctcccctgtgtctttcagcgagctcttctgcccagggggacccctggccttaagtgggataggtaagtggatcctgctggggtcgtggaccatgagccaggtcgctttgggtcactgagagtcacccttcaggccacgagggattcctcagggagcccatctgaaacccaccagggacggatggtttctccaggaggacagcttccttggaagtcggtcccaagaaggatgccttccctgaagccgtgcagagatgatggacgtccaagcaggaagggcttccttcaactcaatgcagtgcacatcctagctgagactcagtgcacaagtcaggcctggaggacttcccaggccacatgagggggtccacagggtctccaggggccacgggtgttatgagggtgctctctgtccccgaggcttgcagaggggcagggtgtgggtgatcggacttatggagtcaggccgtgaagattcaaggattgggcccaacccatggcccagcatgggccgaacctgtagagcaatgggccatcccggtggtgcatccttgagccttgtgggggtggtgtgaccttagtggggttgggtcaagcctgagctctggccttcacctggtggtgctgcaggctggccctgggaatttgggctttgggccaagggtgcagtctgtgtcccgctaaaggtcacccctccccaaagtggagtggccagaaggatggcatcctgtggtagaagtcccactgtcaagggtcctgtcctggcaatttgttgcccaggctgcttctaagccatgggttcacctccaaagtggcggggtcttgagccgaaggaaaggggaagacatcatgtgttccctgattgactgagcatggcctggctctgcatttggaggtgtgcggtgcacgaatggggacccatcagagaaggcatgtggccctggggctccaggatttgatttctggtgtgagcttttacagggggtctgtagtggcacgtagcattcaggtcagcctacttggtttgctctgagcttgttggtggtcctggccctgcccagtggtcccattgtggcatagagtcatgtgagggagctgtggcaaggagggccaagggttccccacattcatgatcgttactgtttacatggatcccatctcttgagtccatggagggacagcatgtgtgagccagcaccccctgcccactttcctgcatggaggcgtgaggccgtatttctatacgtgtcccccacccctccagatggtgaccccagaggaagacgtgcattgggtccgctggccccaggccagtgtctctcagccatgtgctcaacacctggtgagctgaagctcaggcccttcctggcatcctggtctcctgcactgagctgtggtgagcacatctgggttcctctggatacgtgtgcagggagggggatgcactgggtcgggtcaatgatgagaaccttatattgttctgaagagaggtgatgacttaaaaatcatgctcaataggattacgctgaggcccagcctaggtgagaattttggaagaggatgctgggatcccaagttccccagcatggccagtatattttaggcaggagaccctgaggctctgaacggcatctccggggggcacaaccctggctctgggctcctctgggaggcagcccaggttccctgtgcaggcttgggctctggttccctgagcccccattctccctcgtgtgtttcagtgagctcgtcctcctaggtggggcccccaggcattgaccggcataggtgagtggtcctgctggggtcatgggtcatcagcaggttggagtcaccaagggtcagcctttgagacaggagggtttccacaggcagccgacctgaatccacaccatggagggatagattggtcctccaagagggctgttttttttcggaatcagacccaaggaggataccttccctgcagccctgcggggatgacggtggtccaggcagggaagggttccttcagtctcacgcaggtcagctcccagctgagtctcagtgcattggtctggcctccaggactgaccaggccacgtgaggggggcaacaggggcttcgggatgcagtggggtcacacaggatctctccatccccagagaaaggtgggcatagaacccatggattcgagctgcagagattcaagaatcgcacacgaattattgccctgaatgggacccaccctgttgagcaatgtcccatcccagggcacctctttgagcctgaagggggtggtgctgtttccctaggtttgggtcaaggctgagctctggccagtgcctggtggtgctgtagtcctgtcatggactcgttagctttacgccaaggggtcagcccacgtcctactggggatctccccttccctgtggctggaagtcaccccttccccattggcaagtgtcaggaagggtgacctcctgaggtggaagtcctgttgagggtcttgtccctggaatatgccacgcatgctgcttctgagccatggggtcacctccagggtagcgggtcttgggcccaaggaaaggagaagtcaccatgtgtcccccgattagccaagtgcggccctgctctgtgtttaggaggtgtgtggggcatggatggggacccaccagagaaagcatgtggcccagggaccccaggttgcaatttctaggacatgctgggatagggcacctgtgtgggtgtccacagtgcacagggataggctatgtgacttgcaggtctgcagcggcatctggcatccaggccagcctccttggtgggccgtgaactgaatggtggcgctggcctgtgcccagtatatctggtatgaccctggggtcgtgtgggggagccggcatgggcagtggaggtgcttatgggacctgcagtaggacacagtcggggcttcttgcccaagcccagtgacccgcttgccctgtccttccagggttcggtggctgagagagcttttgttgccctgtgtccgtgacgggccagtgttctgcatgcatcccatcacatggatccatggagggtgagcatccctgggctgacacaccccaccttctgcccccatggaggggtgaggttgtgttttcacacctgtcttactcctgtttccccagatgttgagcccagaggaagacttgcactgggcccaatggccccaggtcagcgtccatcagccaggtgtccagcccctggtgcactgaagatcgggcccttcctggtgccctggtctcctgcattgagctgtggtgagcacatccggatcctgctggatgcgtgtgcggggaagggggtgccctgggttgggtcaatgagaaccttatattgtcctgaagagaggtgataacttaaaaatcatgctcaataataggattacgctgaggcccagtctaggtgagaggtttggaagaggatgctgggattccgaggtccccaggagggcccctgtatttttggctggagacctggaggccctgaagggcatcttgtgggtgcccaaccctgtctctgcgctcctccttgaggcagcccaggctccctgtgcaggcttggtgtcagccctccagttccctgggtttgaggcacatgggaagctcctttctgagccccgttctcctcttgtgtctttcagtgagctcttccacatggaagacccctgtcattgactggcataggtgagtggctggcatcatgggccatgagccaggccgcgtgaggtcgccaagggtcagccttcgggaaagaagggtttcctcagggagccaacctgaatccccactgggaagatatgggttctccaggagggcgacttcctgggaaacaagaaccaaggaggtccccttccctgaagccctgcaggggtgacggtggtccaggcaggaaagggttccttcagttccacccagggcagctcccagctgaggctcggtgcttgcgtctggacttaaggactgccctggccatatgaggggtgccacagtggctctggggtgccatggggtcacacaggcactctctgtccctggagaaaggtgggtgattgggcccatggagttgagctgttgagatgcaagttttgcacctgacacatggccctgaatgggacccaccctgttgagcaatgggccatcccatgggcctcttcgagcctgaaggggggcggtgctgtttcactgggtttaggtcaaagctgacctctggccgccacctggtggtgctgcagtccagcccttggactcgtgggctttgggccaagggggcagcctgcatcccactgaaagtcaccccttccctgtggctggaagttatcccttcctcatgggcgagtgttgggaagggtggcctcctgaagtgggaaggcccgctattgagggtctgctcctggcaatttgctgcccatgctgcttctgagccatggagtcaccaccagtgtggtggggtcttggacccgaagaaaggagaagacactgtgccccccgattagctgagtgtggccaggctgtgtgtttgcgaggtgtgaagggcatggatggagactcaccagagaaagcatgtggccctggggccccaggttgtggtttccagtatgtgcttggatatggcatatgggtgggtgcctaccatgcacagggactggctatgtgactgccagctgtgcagcagcatcaggcatacgggccagcctccttggttgaccatgaactggttgctggccctggcctgtgcccagtagtcctggggtgaccctggtgtcatgtaggggagctggcatgtgtagtggaggtgctcgtgtggtctgcagtagggagcagccctggcttctagcctgagcccagtgacctgcctgtcctgtcctttcagggttcagtggcggagagagcatcaggtggcccacgtctgtgatgggccagtattccacatggatctcatcacatgggtccatggaaggcgagcatccctgagctggcacaccccaccttctgccagcatggaagggtgaggttgcatttggcacctgtcctcttcctgttcctcgagatggtgaccccagaggaggacttgcattgggcccactgtccccgggccagtggccatcagccgggtgcctagcccctgttgcactgaagctcaggcccttcctgttgccctggtctcctgcattgagcttgggtgagcccatccggttgccactggatgcctaagcagggaggggggttccctgggttgggtcaatgatgagaaccttacattgttctgaagagagatgatgacttaaaaatcatgctcaataggattacgctgaggcccagcctaggtgagaattttggaagaggacgctgggatccctaggtccctgacagggccactgtattttgggctggagacctggagtccttgaagggcatctggagggggcccaaacctgtctctacgttcctccatgaggcagtccaggctccctgtgcgagcttcgtgtcggtgctcagattccccttggtggtgcatgtgggtggctcatccctgagcccctgttctccccttgtgtctttcagtgaactcgtttgcccaggaggacccctggccttgagcagcataggtcagtggatcctactggggtcatgggccatggaccaggccacgtggggtcactgagggtcagctatcaggacaggagggattcctcagggagacaacctgaatccccactggtgagggattggttctccagaagggccgcctccttgggaatctgacccaaggaggacaccttccctgaagtgctacaggagtgacattggtccaggcaggaaagggttccattagtcccatgcaggtcagctcccagctgagacttggtgctagggtctggccttgaggactgcccaagccacatgaaggtggccccaggctgtgatttttggtgcgtgcttggagagggagtctgggcaccctccctgcacaggggcaggctgtgcgtctgccaggtctacagtggcgcctagcttcagagcaagcttccttggttggccttagctggttggtggccctggctcctacccaggggtcacaatgcagcccaggaagtgcagggaagccggcttggacagtggaggtgctccaggggcctgcggtagggcacagcctcggcatcttgcctgagcctagttactcgcctgtcctgtccttccagggtttggtggtggggagatacaagggttccccaggtccataactgtcctcgtttcacatggatcccatcacatgagtccacggatgtagagcatgtgtagccagcagcccctccccgctttcctgcatggaatcttaaggccctatttggacacctttccccgtccctccagatggtgagcacagaggaagaattgcgttaggccctttggccccggaccagtgtctgccagccacgtgctcagcctcccgtgcgctaaagctcaggtccttcctgtcatcctggtatcctgcactgaggtgtggtgagtccatccaggtccctctggatgtgtgagtggggatgggggtgtcctgggttgggtcgatgatgagaaccttatattgtcctgaagagaggtgatgacttaaaaatcatgctcaataggattacgctgaggcccaacttaggtgagaattttgaaagaggatgctgggaatcacaaggtccccggcaggaccactgtattttaggcgggagacctcgaggccctgaagggcatatcatggaggggtacccaacccagtctgtgctcctccattaggcacaccaggcttcctgtgtgggcttggtgtctgcactcagcttccccgggggtgggacacattggtggctccttcctgagtcgcattctcctctgtgtctttcagtgagctcttccccccagcaggccccctgggattgactggcaaaggtgagtggatactgctcgtgtcatgggctgtgagccaagctgcgtggggtccccaagggtcagccctcgggtcacctgggtttcctcaggagctgatctgaatcctgactggggatgtgttctccaggagggcagcttccttgggaatctgacacaaggaggaggccttctctggagccctgcaggggtggtggtggtccaggcaggaaagggtttcctcagctccacacaggacagtggagctgggcagtgctcagctcagacttggtgctcaggtcaggcctctaggatggccaggccacatgacgggggccacaagggctccagggcaccacagacatctcatgggggctctccaaccctggagaagggtgggcaatttggcccattgggtcgggtcatggagcttcaaggattgcaccaaacccatatccctcaatgggaccgaccctattaagcaatgggccatcccagtggcacctctttgagccatgtggtgggtggcgctgtttctctgaggttgggtcaagactagctccggccagtgcctgatggtggtgcagtccagtcctgggactcgtgggctttgggccaagggtgcagcccgtgtcctactggggatcaccccttccttatgagggagtggtgggaagggtatcctcctgaggtaggaaggcccgctgtggaaggaactttcctggaaatttgcagtccagactgcttctgagccatgaggtcatctccggggtggcggggtcttgggcccaaggaaaggagaagacaccatatgtctcccgattggttgagtatggctccactctgtgtgtgggaggtgttgtgtggggcatggattgggacccaccagagaaagctcgtggcactggaaccccaagctgcaatttccagtgcaccttgggaaggggactgggtgctcaccctccatgcacagggcaggctgtgcagctgccaagttggcagtggtgcgtggcatccgggccagcgtccttggttcgctgtgagctggttggtgtccttgacgcctgcccaggggtcccagtgctgcttggggtcatgaggggagccagcgtgggcaagggaggcctgcagtagggcacagcccgggggtcttgcctgagcccaggatcctgccggccctgtccttccatggttcggtggctgggagggcaaagggtcccccacgtctgagacacatcagtgtttcacatggatctcatcacatgggtccatagagagagagcaagcgtgagctgacaccccccacccccttccctgtatagaggtctgagcccctggttggacacatgtcttcctcctgtccccccagatggtgtctgtggaggaagacttgccattgggttgctggccccaggccagtggttgtcatccaggtgcccagccttggtgcactgaagctcaggcccttcctggtgctctggtctcctgcactgagctgtggtgagcacatccgggtcccactggatgggtgtgtgtggtggggggtgccctgggttgggtcgatgatgagaaccttatattgtctgaagagaggtgatgacttaaaaatcatgctcaataggattacgctgaggcccagcctaggtgagaattttggaagaggatgctgggaattacaagttccctgtgaagtccactgtattttgagctagagacctggaggctctgagggcatctggagggtgcccaaccctgtctctgcactcctccatgaggcagcccaggctcactctgtgggcttggtgtcggcgctcctgttacccaagggtggggtactttggcatctcctccctgagcccccattctcccctgtgtctttcagtgacctcttttgcccggcagaccccctggcattgaccagcataggtgagtggatcctgctggggtcatgggtcatgagccaggctgtgtggggttgccgagcatcagcctttggctgcaagggtttcctcaggaactgacccgaatgcccacctgggatgggttctccaggagggcagcttccttaggaatcggacccaaggaggataccttccatgaagccctgcaggggttgtggtggtccaggcagtaaagggtttcctcagccccatgcagggcagcacccagctgaaactcggtgcttaagtcaggcctctaggatggcccgtccacatgaggggaaccacaagggcactggggcgccaagggggtcttatgggggctctccgaccttggagaggtatgtgtgattcggcccatgaggtcaggttttggattttcaaggatctctccaaacccatggccctgaatgggaccgaccctattaagctatgggccatcccagtggtgcctctttgagccaagtgtggggtggcactgtttccatgaggttgggtcaagactagctctggtgaccccatgatggtgctgcagtctggccctgggactcgtgggctttgggccaagggtatagcccatgtcccaccaggggccacaccttccttgtgggcaagtggcggacagggtgtcctcctgaggtgagaaggcctgctgtggaaggacctgtccaggctgcttccaagctatggggtcacctacagggtggtggggtcaaggaaaggagaagacaccatgtgtctcccgattggctgagtgtggccccactctgtgtgtgggaggtgttgtgtgaggcatggatggggacatatcagagaacacacgaggccctgggtccccaggctgcaatttccggtgtggtgtggagcagggcctgggtgcttgccctccacacacaggggcaggctgtgctactgccagattggcagcagtacgtggcatccaggccagcctccttggttggccgtgagacggtaggtggccctggctgacacccaggggccagtacagccctggggtcatgtgaggcaactggagtgggtagtggaggtgctcaaggtgcctgcagtagggcatagccagggcgtcttgcctgagcccagtgacctacctgccctgtccttccagggttcagtggtgcagagggccaaagttcccctgtgtccatgacacatcagtgtttcacatggatcccatcacatgggtccatggtgggagagcaatcgtgagctagcatcccccacccccttcctgcatggaggcgtgaggttccatttggacacatgtccacctcctgtcccccagatagtgagactggaagaaaactttcattgggcccgctgtcccggggtgagtggtcatcagtcaggtgcccagcccttggtgtggtgaagctcaggctcttcctggcgccctggtctcctgcacggagctgcggtgagcacatccgggtcccgatggatgcatgcgtggggatggagggcgtgccctgagttgggtcaatgatgagaaccttatattgtcctgaagagaggtgatgacttaaaaatcatgctcaataggattacgctgaggcccagcttaggtgagaattctggaagaggatgctgagatccgaagtcccctggaagggccactgtattttgggctggagtccttgaggccctgaaggacaccttcggggtgcccaacccagtctctgcactcctctgtgtggcagccaaggctccttgtgcaggcttggtgttggcattctggttccctgggggtggagcacatcgacggctcctccctgagcccccgttcttctctgtgtctttcagtgagctcttctacccaggcgggcccctgcccttgagcggcataggtgagtggatcttgctggggtcacgggccaagagccaggccacggggggtcgctgagggtcacctttcaggccacgagggtttccttagggagctgacctgaatccccaccagagatggatggtttctccggaagggcagcttccttgttaattgatcccaagaaggacgccttccctgaaaccctgcaggggtaatggaggcccaggcagcagagagttccttcaacccaatacagtgcagcagcttgttgccttgatgctccccctccctggagaaaggtgggcatagggcccgtggagttgagttgcagagatttaaggatcgcacaggacttattgacctaaatgggactgaccctgttgagcaacgtgcacttggtgcatgggtcaggtgtggagcactgcccaggccacatgaggggtccactgggtctctgggggccacgggtgttatgcaggagctctccgtccccaaggcttgcaggggggtaggatgtcggtgatcgagcttatgcagtcaggccgtgaagattcaaggattgggcccaacccatggccctgatgggaccgaccctgttgagcaatgggctatcccactggtgcctccttgagcctggtgggggcagtgcggcctcagtgggcttggatcaaggctgagctctggccagcacctggtgtttggccctgggaatcgtgggctttgggccaagggttcagcctgtgtcccactggagttcatccctaccggaagtggagtggatggaagggtggcatcctgtggtggaagacccaccgttaagggtcctgtcctggcaatttgatgcccaggctacttctgagccatggagtcacctccagggtagcagggtcttgagccaaaggaaagttgaggacatcatgtgtcctctgattggccgagcgtggcccagctctgtgtttaggaggtgtgcggtgcatgaatggggacccaccagagaaggcatgtggccctggggccccaggatgtgatttctggtgtgtgcttataaagggtgcctggatgggttcatttaatgcccaggggcaggccatgtgactgccaggtctgcagtggtacgtggcatccaggccagcctccttgatttgctgtgagctatttggtgcccatggccctgcccagtggtcctgatgcagcccagattcgagcaggggatttggcgtgggcagtggaggtgctccagggtcctgcactagggtgcagcctgggcgttttgctcgaaccctgtgaccctcctgccccgtccttccagggttcagtggccaagggttcctcgcgtaaatgaccatcactgttttacatggatctcatctcatgagtccatggagggagagcatgtgtgagccagcaccccctgcccactttcctgcatggaggcatgaggccttgtttggacacctgtcccccacccttccagatggtgaccccagaggaagacttgcgttgggcccactggctctgggctcagcccctggtgagctgaagctcaggcccttcctggcaccctggtctgctgcactgagctgcggtgagcctatctgggtcccactggatgcatgggttgcggggcagtggagggtgatgccctgggttgggtcgatgatgagaaccttatattgtcctgaagagaggtgatgacttaaaaatcatgctcaataggattacgctgaggcccagcctaggtgagaattttggaagaaggtgctgggatccggagttccctggaatgaccaatgtattttgggctggagaccttgaggccctgaacagcagcatctcgtgggggcccaaccccttctccgtgctcctctgtgaggcagcccaggctccctgtgtgggcttggtgttagtgctccggttctgtgaacccccattctccccttgtgtctttcagtgagctcttccacccaggtgcaaccccctggcattgaccagcataggtgagtggtcccgctggggtcatgggtcatcagtcatgcagtgtggggtcaccaagagtcagcctttgagacaggagggtttccacaggcagctgacctgaatccacaccatggaagggtaggttggtcctccaagagggctgtttttttgggaatcggacccaaggatgatatctttcctgcagccctgcagtgatgacggtggtccaggcaggaaaagtttccttcaatctcatgcagggcagctcccagctgagtctcagtgcactggtctggcctcgaggactgaccaggccacgtgaggggggccacaggggctttgggatgccatggggtcacacaagagctccccatccctggagaaaggtgggcatagagcccatggagttgagctgcagatatttaaggatcacacaggatttatagccctgaatgggaccgaccctgttgagcaatgtgccatccatcctatggtacctctttgggcctggatggggtgttgctgtttccctaggttttggtcaaggctgagctctggccagtgcctggtggtgctacagtccagccacggacttgttagctttaggccaagggatcagtccacgtcctgctggggatctccccttccctgtggctggaagtcaccccttccccattggcaagtgtgaggaagggtggcctcctgaggtggaaggcctgctgttgagggtcttgtccctggaatatgccacccacactgcttctgagccatagggtcacctccaggatagtgggtattgggccaaaggaaagaagtcaccatgtgtcccctgattagccaagtgtggccctgctctgtgtttaggaggtgtgtggggcatggatggggacccaccagagaaagcatgtggccctgggactccaggttgtgatttccagttcatgctgggatagggcacctggatgggtgcccacaatgcaccggggcaggctatgtgactgccagctttgcagcggcatctggcatccgggccagcctccttggttggccatgaactggttggtggccctggcctgtgcccagtagctctgtcgtaatcctggggtcatgcgagggagccggcatgggcagtggaggtgctcgtgggacctgcggtaggacacagccaggtcttcttgcccgagcccagtgacccacctgccctgtccttccagggttcagtggttgagagtacagggtgacttgtgtctgtgacaagccagtgttctgcatggatcccatcacgtggatccatggacggcaagcatccctgagccgccacaccccaccttctgcctccatggaggggtgaggttgtgtgtggacgcctgtcctactcctgtttccccaggtattgagcctggaggaagacttgaattggtcccaatggtcccaggccagcatccatcagctaggtgctgagcccctggtgcactgaagattgggcacttcctggcaccctggtgtgctgcaccgagctgtgatgagcacatccgggtcctgctggatgcatgcgccgggaaggacgtgccctgagttgggtcgatgatgagaaccttatattatcctgaagagaggtgatgacttaaaaatcatgctcaataggattacgctgaggcccagtctaggtgagagttttggaagaggatgctgggatcctgaggtcccctggtagagccaattgtattttgggctggagacctggaagccctgaagggcatctgggaggcccaaccctgtctctgtgctcctccatgaggcagccctggctccccatgtaggcttggtgatggccttcctgttccctgggggtggggcacatgggtagctcctccctgacccccattctctcctgtgtctttcagtgagctcttccccacaggtgggccccctggcattgactagcatcggtgagtggatcctgctggggtcgtgggccgtgcaccaggctgcatggggtcaccaagtattagccttcaggacaggagggtttcctcagggagtcgaccttaatcctcacctgtggagagatgggtttgtcctctaggagggcagcttcctgggaaatcagacccaagacgatgccttccctgaagccctgcaggggtgacggtggtccagtctggaaagggttccttcagtctcatgcagggcagctcccagctgacacttggtgtgagagtctgtccttgaggactgcccaggacaaatgagtgggacaacagaggctcccggataccacagggatcactcaggggctctccgtccctggaaatgggtgggcgatcgggcccatggggtggggctgcggagattcaaggatcgtgccctgctcatggccctgaatgcaaatgaccctgttgagcaatgggtcacaccagtagctcctttttgagcctggtgggtggcggctcagcttcaactggttgggtcaaggctgagccatgactggtgctttgtggtgccgcaggccaaccctgggactcatgggctttgggtcaagggtgcagcccgcctgctgctgggggtcaccccttcttcgaggtcagtggcgggaagggtcacgtcccgaggttggaaagccccctcatgagggacctgtcctgggaatttgttgcccaggctgcttctgagccatgtggtcacttccgggtggcggggtcttgggcccaaggaaaggagagggcaccatgtggctcctgattggctcagtgtggcccagctctgtgtttgacaggggtctggggtgtggatgaggacccaccagacaaagcacgtggccctgggcccaggctgtgatttctggtgcgtgcttggagaaggatcctgggcaggcattctctccaaacaggggcaggttgtgggactgccagattggcagcagtgcctggcatccaggccagcatccttggttggctgtgagctggttggtgaccttggaccctgcccagggtttccgttgtggtccagagtcatgcagtggggccagtgtgagcagtggaggtgctccaggggcctgctgtatggcacagccagggcatcttacccaagccctcctgcactggtctcctgcactgagctgtggtgagcccatctgggttcctgtgatgcctgtgcggggagggggttgccctgggttgggtcgatgatgagaaacttatattgtctgaagagaggtgatgacttaaaaatcatgctcaataggattacgctgaggcccagcctaggtgagaattttggaagaggatgctgggaattatgagttccctggcagaaccactgtattttgggctggagacctggaggctctgagggcatctggagggtgcccaaccctgtctctgcgctcctccgtgaggcagcccaggctcactatgtgggcttggtgttggcactcctgttacccgggggtggggcattttggcatctcctttctgagcccccaatctcccctgtgtctttcagtgagctcttctgcccagcagcctccctggcagtgaccagcataggtgagtggatcctgctggggtaatggcccatgagccaggctgtgtggggtcaccaagcatcagccttcagccataagagtttcctcaggagctgacccgaatgcccacctgggatgggttctccagaagagtggcttccttggaaatcatacccaaggaagataccttccctgaagccctgcaggggttgcagtggtccaggcagtaaagggttttctcaacctcatgcagggcagtgccccactaagactcagtgctctggtcaggcctttaggatggccaggccacatgagaggggccacaagggctctggggcaccaaggggttcttgcaggggctcttcaaccttggagaggtgtgtgtaattcagcccatgaggtcaggctgtggattttcaaggattgcaccaaacccatggccctgaatgggacaaaccctaataagttatgggccatcccagtggtgcctctttgagccaagtgtggggtggcactgtttcctaagggtgagtcaagactagctctggctggcacctgatggtggtgcaatcctgccctgggattggtgggctttgggacatgggtacagcccatgtcccattggggtcaccccttcattgtggacaggtggcgggaagcatgtcctcctgaggtgggaaggcctgctgtggaagaccctgtctcagaaatttgctgtcttggctgcttctgagctatggcgtcacctctgtggtggcgggagtctcgggtgaatggatcctgctggggtcatgggccatgagccaggccggggtggggtccctgagcgtcacctttcgggtcatgagggtttcctaagggagccgacctgaatccccaccagggatgaatggtttctctgggaagcaggtttccttggaaatcagtcccaagaaggacaccttccctgaaaccttgcaggggtaacagaggtccaggcaagagagggttctttcaacccaacgcagtgcagatcctagctgagacttggtgcacaggtgagtcctggaggactgcccaggccacatgagggcatccacagggtctccgtggccaggagtcttatacgggagccctctgtccccgaggcttgcagaggggttgggtgtgggtgatctggcttacggagtcaggccgtgaacattcaagggtcgggaaccacccatggccctgaatgggaccgaccctgttgagcaatggccatcctggtggtggcaccttgagcctggtgggggtggcgctgcctcagtggggttgggtcaaggctgagctctgcctgtcaccttgtggttggccctgggaatcatgggctttgggccaagggtgcagcctgcgtcccgcttgaggtcactcctacctgaagtggagtggccggaagggtggcatcctgtggtgggagacccacggtcaaggatcctgtgctggcaatttgctgcgcagcctggttctgagtcatggggtcacctccagggtgacagggtctttgtcaaagggaaggagaggacattatgtggcccctgattggccaagcatggcccagctctgtgtttgggaggtatgcggtgcctgaatggggacccaccagagaaggcacatggccctggggccccaggatggtatttctggtgtgagcttataaagggtgcatggatgggtgcattccatgcccagtggcgggttatgtgactgccaggtctgcagtggcacatggggtccgggccagcctccttggtttgccatgagctggttggtggcccaggccctgcctagtggtctcattgcagcccagagtcatgtgggggagctggcgtgggcagtcgaggtgctccagggtcctacagtagggtgcagcctgggcgtcttgctggaatcccatgacccacctgccctatccttccagggttgagtggcagggagggccaagggttcctcgtgtgcatgactgtcactgttttacatggatctcatctcatgagtccatggtgggagagcatgtgtgagccagcacaccctacccactttgccctatggaggcacaaggccctgtttggacacctgtcccccacccctccagatgctgaccctggaggaagaattgcactgggcccactggccccgggaaaatgtccctcagccaggtgcttagcccctggtaatctgaagctcaggcccttcctgatgccctggtctcctgcactgagctgtggtgagcacatctgggtcccaatggatgcatgcatgcgttgtggggtggtggtgtcctgggttgggtcgatgatgagaaccttatatgttctgaagagaggtgatgacttaaaaatcatgctcaataggattacgctgaggcccagcctaggtgagaattttggaagaggatgctgggatttctaggtccctgtcatgggcactgtattttggactggagacctccgggccctgaacagcatctcgggggggactctaccctgtctccacattacatgtgaggcagcccaggctccctttgtgggcttggtgtctgcactctggttccctgtggtagggcagcttgctgggtccttcctgagcccctgttctccctttgtgtcttctgtctttcagtgagctcttcagcccaggtgggctccctgacactgatgcgcataggtgagtggattctgctggcatcatgggccatgagccaagctgcgtagggtcaccaaaggtcactctttaggccacgtgggtttcctcagggagccgacctgaatccccaccaggttgggacagtttctccaggaggctggcttccttgggaatcagacccaagacaatgccttccctgaagccttacaggggtaacagttgtccagacaggaaagggtcccctcagtcccattgaaggcagctcccagctgagactcagtgtgcgagtctggcctcaaggatggcccaggccacatgaaggaggccacaggggctctggggtgccacaggggtcacacgagagctctctttccctggagtggggtgctcgaatgagcccatggggtcaggctgcagagattcaaggatcgcatcccaaccgtggccctaaatgcgaccgaccatgttgagtaatgggccatctcagtggggcctctttgagcctggtggggggcggggctgtttccctgggtttgggtcaaggctgagctctggccagcgcctggtgatgctgcaggccagcccaggttcttgtgggcgttggtccattcggcagccctgtcctcctggaggtcaccccttgcctattggtgattggctggatcctgaggtggaaagacctgctgttgatggtcctgtcccaggaatttaccacccaggctgcttctgagccatggggtcacctccagggtggcggagtcttggggctaagaaaaaagaggacactatgtagcccacggttggccaagggtggcctgactctgtgtttgggacatgtgcggggcatggatagggacccgccagagaaagcacgtggcccggggactccaggcttcgatttcaggtgtggcttgcaaatagcacctaggcaggtgcccaccacgccctggggcaggctatgcaacttccatctccacagtggcgcatggcttctgggccattctccttggttggccatgagctgattggttcccctggcctgtgccctgtggtcccggagtggctctgggatcgtgtggggcagccagcatggacagtggagatgctatcaaggccttcagtagggtgcagcccaggtttcttgcctgaacccagtgacccacctaccctgtgttttcagggtttgctgacagggaaggccaaacgtgccccacgtccatgctaggtcagtgttcctcatggaccccatcacatgggtatcccttaccccttccccacatggaagtatgaggctctgtttggacacatgtcctcttcctgtccccccagatggtgagcctggaggaagacttgcattgggcccaatggacccaggccagtggccatcagccaggtgcccaccctggtgtgctgaagcgcgggacctacctgttgtcctggtttcctacactgagctgaggtgagcacatctgggtccctctggatgcatgcatggggcggggggtgccctggtttgggtcaatgatgagaaccttatattatcctgaagagaggtgatgacttaaaaatcatgctcaataggattacgctgaggcccagcctaggtgagaatttggaagaggatgctgggatcccaaagtcccagtaggggactttatttatttattttgggctggagccctggaggccctgaagggcatctggggggcccagccctgtctctgtgctcctccgtgaggcagcccagcctccctgtgtgggcttgctgttggtggtccagttccttggggcggggcacgtggacagctcctccttgagcccccctgctccacttgtgtctttcagtgagctcttcaacccaggcggggcaccctggcattcaccagcataggtgagtggatcctgctgccatcgtgggccatgggccaggctgggtagagtcactgagggtcagccttcgggacaggagagtttcctcagggagcgaacctgaatccccaccagggagggataggttggtcctccagaagggtggcttcctgagaaatcggacccaagggggacgccttccctggagccctgcagtgatgacggtggtccaggcaggagagggttccttcagtctcacacatagtagctcccagctgagtctaggtgttcgagtctggccttgaggactgcccaggccacctgaggggccaacagggactctgggacaccatgggggtcacataggagctctccattcatggagaaagatggatgatagggcccatggagtcgagctgtggagatttaaggattgcgcccaatgtatggccctgaatgggacagaccctgttgagtaatgagccattctatgggcctcatcgagccttgagcggggcggtgctgtttccctatgtttgagtcaaggctggactctggccggtgcctggtggtgctgaggtctggccatggactcgttggctttgggccaaggggtcagcctgctccccctggaagtccccccttccccgtggctggaagtcatcccttcccaaggggcaagtgtcgggaatggttgcctcctgaggttgcaaggcctgctatctagggtcttgtctttggaatatgctgcccatgctgcttctgagtcatggggtcacctccagggtagcggatcttgggcccagggacagaagatgccgtgtgtcccctgattagctgattgtagccctgctctgtgttcaggaggtgtgtggggcatggatgcagacccaccagagaaaactgtggcccttagaccccaggttgcaatttccattatgtgctgggatagggcatctgggtgggcacccactatgcacagagataggctatgtgactgccagggctgtagcggcatctgacatctaggccagcttccttggtttcctgcgaatgagttggtggccctggcctgtgcctagtagttctggggtgaccccgggtcgtgtgggggagccagcaggggcccagtgaccagcctgccctgtccttccagagttctgtggctaagagagcactgggtaccctgtgtccgtgatgggccagtgttccgcatgcaaacgatcacatgggtccatggagggcaagcatacttgaactgccacaccccaccttctgctcacatacaggagtgaggttgtgtttggacagctgtcctactcctgttcccctagactgtgaaatgggaggaagaattgtgttgggcccaatggccctgggccagtatccgtcagcctggtgtccagcccctggtgtgctgaagctcatgcccttcctggtgccctagtttcctgcactgagcttggtgagcccatttgggtactgctggatgcatgggtggggagggaggtgccctgggttgggtcgatgatgagaaccttatattgtcctgaagagaggtgatgacttaaaaatcattctcaaaaggattatgctgaggcccaccctaggtgacaattttggaagaggacactggaaatcaatgaggtccctggcagggccactataatttggggtggagacctggaagccctgcagggcacctcgtgggggcccaaccctgtctcttcactcccctgtgaggcagcccaagctccctctgtaggcttggtgtcggcactctgctttcctggaggcggggcattttggctgctccttcctgagcccctgttctcccctgtgtctttcagtgagctcttttgcccagaagactccctggcattgatcggcataggtgagtgtctcctgcttgggtcatgggccatgagccagaccatagggttgccgagggtcagcatttgagccatgagggtttcctcaggaggcgacctgaatccccacctgggatgggttctccaggagggcagcttccttgtgaatctgagccaagtaagatgccttctctgaagccctgcaggggtgccagttgtgcaggcaagaaagggttccctcagccccaggcagggcagcgcccagcagagactcggtggttgggttaggcctctaggatgaccaggccacatgaggggggccacaagggctctggggcacaacaggggcttcgcagggtctctgcgaccccaaagagtggtgggcgattcggcccatgggatcgggccccagattcaaagatcacaccacacccatggccctgaatggaaccgaccctgttaagcattggggcatcccaggggtgccactttgaacctggtgtggggtgccgctgtttgcctgaggttgggtcgagactagctccggccagcacctgatggtggtgcagtccggccctgagattagtgggctgtgggcccagggtgcagcctgtgtcccgctgggggtcacctcttccttgtgggcgagtggtggaagggcatcctcctgaagtgggaaggcccgctgtggaaggaactgtcctggaaatttgccatccaggctgcttctgagccatggggtcgcctccagagtggcagggtcttgggcccaaggaaaggagaggacactgtgtttccctcaattagctgagtgtggccctgctctctgtgtgggaggtgttgtgtggggcatggatagggacccaccagagacaacacatggccctcgggccccaggctgcaatttctcagtgcatgcttggagacggtcctgggcctcctccatgcccagggtcaggctgtgcaactgtcaggttagcggcggcatgtggtgtctgggcctgtctacttcgttgtccgtgagctgctggtggccctagccctttcccaggggttcaggtgcagccctggggttgtgtgggacagccagtgtgggcagtggagctgctctggaggcctgctttagggtgcagcctgggtgtcttgcccgagtgtagtgacccgcctgccgtgtcctcacggggttccctagcaggaagggccaagggtcccctgtgtctgtgacacgtgagtgtttcccatgggtcccatcaaatgggtccacggagggagagcatgagtgaactggtaccccccacccccaccctcttccccacctggaggcatgagcccctggttggacatatgtcctcctcctgtacccccagatggcagcgctggaggaggacttgtactggggccgctggccccacatcagtgtccgtcatcccggcgtccagcccctggtgtgctgaagctcaggcccttccttgtgccctagtctcctgcactgagcttggtgagcccattcggatactgctggatgcatgggtcgggagggaggtgccctgggttgggtcgatgatgagaaccttatattgtcctgaagagaggtgatgacttaaaaatcattctcaaaaggattatgctgaggcccggcctaggttagaattttggaagaggatgctgggatcctgaggtccccaggagagcccctttatttttggctggagacctggaggccctgaagggtatctggggggcccagccctgtccctatactcctctgtgaggcagcccaggctctctgtgtgggcttggtgttggcactctggttttctgggggcggttcaggttgctggttccttctgaaccattgttctccccttgattctttcagtgagctcttctgctcaggcgggtcccctggcattgaccagcataggtaagtggatcctgctgggttcatgggccatgagccagaccacatggagtgactgagggtcagccttcaggacaggaagatttcctcggggagccaacctgaatccccaccgtggagggatgtgttagtcctccaggagggtggcttcctagggaatctgaccccaggaggacacctttgctgaagccctgcaggggtgatggtggtccaggctggaaagttttccttcagtctcatgtggggcagctccctgctgacattccgtgcctgcgtctgaccttgaggactgcccgggccacatgagtggggcaacaagggctccagggtgccacggggattatgagtggggctctccatccccggagagaggtgggcaatcaggcccatgtggtcaggcttgtagggttcggtggtggggagagccaaggtttccctgggtccattaccgtcactgtttcacctggatcccatcacatgggtccatggagggagagcatgtgtgaacaggcaccccttgctccctttcccacatgagcccctggttggacatatgtcctcctcctgtccccccagatggtggccctggaggaggacttgtattggggccactggccccacgtcagtgttcgtcagcctggcatccagcccctggtgtgctgaagctcaggcccttcctgttgccctagtctcctgcactgagcttggtgagtccattcggggactgctggatgcatgggcgggtagggaggtgccctgggttgggtcgatgatgagaaccttatattgtcctgaagagaggtgatgacttaaaaatcattctcaaaaggattatgctgaggcccggcctaggttagaattttggaagaggattctcggatcctgagatccccagccaggccactgaatttttggctggagtccttgaggccctgaagggtgtctgagggctgctgaaacctgtctctgtgcttgtccgtgaggcaacccacattcgctgtgtggacttggtgttggccttcccgttctccggggatgggacatactgtcagcttgtccctgagtacccgttctcccctgtgtctttcagtgagctcttctgcccaggtggtccccctggtcttgatgggcataggtgagtacatcctgctggtgtcctggtccatgagccagggtgcgtacggttgccggaggtcacctttaggccatgtgggtttcctcagggagctgacctgaatccccactgggagggatggtttctccaggaggatgtcttccatagaaactggttccaagaaggatgccttccctgaagctgtgcaggggtgacgatggtccaggcaggaaagggtccattcaacccaatgcagtacagcttctagctgagactcggtgcacgggtgagggcttgaggactcccaggcaacatgaggggttccacaggatctccggaggccacaggtgttaagcaggaactctccatccttgaggcttgctgggggtggcgggatggcagcagggtgtgggtgatcgagtttatggattcaggccaagattcaagggtcaggccccacccattgccctgatgggaccaaccctgttgtgcaatgggctgtcccactggtgcctccttgagcctggtgtgggcagcgtggcttcaatggggttgggtcaaggctgagctctggcccgcacctggtggttggccctgggaattgtggactttgggccaagggtgcagcccgcctgcctctggaggtcatcctacccagaggtggagtggccggaagggtggcaggcatcctgtggtgaaaggcccactgttgagggtcctgtcccaccaatttgctgttcaggctgcttctaagccatgggttcacctccagagaggcgggatcttgagcccagggaaaggagagggcatcatgtgtcccctgattggctgagaatggggagagtgtttgggtggtatgtggtgcatgaatggggacccaccagagaaggcgcgtggccctgggccccaggatgcaatttccggcgtgcttatagagggcgtctgagtggacactctccatgcccaggcgcaggctatgtgactgccaggtctgcagcagtttgtggcatctgggctagcctccttgattgcttatgagctggttgatagccctggcctgtgccgaggggtcctggtgcggccctggggttgttcaggggaagccggcatgggcagtggaggtgctcttggggcctgcagtagggcacagcccaggtgttcttgcttgagcgcagtgaaccacctgccctttccttccagggttcggtagcagggagggccaagggtcccccacgtccatgacaggtcagcgttcctcctggatcccatcacatgggtacatgcagggagagcatgtgtgagccggcactccccactctcttccccgcattgcagggtgaggccctgtttggacccatcttccagctatctcaccagatggtgagcccagaggaagaccccgtggctctgggccagtgtgcgtcagccaggtccccagcccccagtgtgctgaagctcaggcccttcccaacgccctggtctcctgcactgaggtgtggtgagcacaaccaggtcccactggatgcatgcacagggagggatgtgccctaggttgggtcgatgatgagaaccttatattgtcctgaagagaggtgatgacttaaaaatcatgctcaataggattatgctgaggcccagtctaggttaaaattctggaagaggatgctgggatcccaagttcacaggcagggccactgtattttggactagagaactcgaggccctaaagggcatcttgagggggtccaacctgtctctgtgctcctccatgaggcagccctggctccctgtgtggccttggtgttggtgctctggttcccaggcgtggcatgtgggcacctccttccagagcccccattctcccctgtctctttcagtgagctcttccgcccatttgggccctctgacattgaccggcataggtgagtggatcctctttgggtcatgggtcatgagcgaggcaaagtggggtcaccatgcatctgccttcgggccatgagagtttcctaaaagtgtggacctgaattcccaccggggatgagttatccagaagggccacttccttgggaatcggacccaagaaggacgcctgtcctgaagcccagcaggggtggtggtggtccaggcaggaaagggttcattcagcaccaagcaggcagctcccatctgagacttggtgcatcggtcaggccttgaggactgcccaggacacatgaggtggccacaggggctccggggcactacagggggtctgcagagaggggtaggcgattgggtccgtgggggtcatgccgcggagtttcaaggacacccatggccctgaatgggactgaccctgttgagtaatgggccatcccaatggcacctccttgagtctggcggtgggtggtgctgtttccctggggctaggtcaaggctgagctctggctagtgcctgtggtgctgcaggctggccctagaactcatgggctttgggccatggggacagcttgtgtcatgcttggggtcaccccttcccggaggttgaatggcgggagtggtggcttcctaaggtgggaagtcctgctattgagcaacctgtcctgggaatttgccacccaggctgcttctgagacatgaggtcacctccagagtggcagcatcttgggtccaaggaaagaggagcataacatgtgtccccagattggttgagtgtggcctagctctgtgtttgggaggtgtgcagggtgtggatggggatgtatcaaagaaagtacatagccctggagccccaggctgtgatttccagtgtgtgcttggagaggggcaggagcaggctctcgactgccaggtctgcagcagcgcgtggcatccgggcaagccttctggttggccatgtgctggttggtggccctggcctgtgcccagtggtctcagggtagacctggcattgtgcagggcagccagcagggcagtggaggtgctctcaggacctgcagtagggcgcagcctggactttttgtgtgagaccagtgacccacctgcactgtccttccagggttgggtggctgggagggccaagggtggtccatgtttgtctccgtgacacatcagtgctctgcatggatcctatcacatggatatcccctacccaccttccccacatggaagcatgaggccttacttggacatgtgtcctcctgtcctagatggtgagctcggaggaagacttgcattgggcccaatggagctgggccagtttctgtcagccaggtccccagctcctgatgcactgaagctcaggcccttcctggagccctggtctcctgccctgagctgtggtgagcccatctgggtcccactggatgcatgcatgggagggggttgccctcggttgggtcgatgatgagaaccttatattttctgaagagaggtgatgacttaaaaatcatgctcaataggattacgctgaggcccaacctaggggagaattttggaagaggacgctgggatcctgaggtccgtggcagggccaccgtattttgggctggagacctcaaggccctgaagggcatcttggcagcccccagccctgtctctgcactcctccgtgaggcagcccaggctccctgtgtgggcttggtgtcagagtcccattccccaggggcggggcaggttggcggctcctccctgagtcccctttctcccttgtgtctttgagtgacttcttctgcccaggtgggccccctggcgttgaccagcataggtgagtggaacctgctggtgtcatgggccatgagccaggccatgtggggactccaggtcagccttcaggacaggagagtttcctcagggagcaggggaatccccactggggagggatgggttctcccagagggccactttcttttgaatcggacccatggaggacatcttctctgaagacctgcagaagtgatgatgtttcaagcagcaaagggttttttcagcccctgcagggcaggcagctcccagatgagattctgtgcatgggtcaggcctcaagaactgcccaggccacatgcggggtgccacacaggctgtgaggcaccacaggggtcatgcaggagctctcggtcttcaggcttgttgtgggggtggtgacagagtgatcaggcccacagggtcaggctgcagtgtttcaaggatcgcgcccacctgtggccctgaatgggaccgatgctgttgagcaatgagccatcccagtggctccacattgagcctggtgggggcgccactgtttcagtggggatgggtgaagcttgagctctggccagcacctgatggtgttgcaggctggcccagggacttgtgggctttgggccaggtcggcagcctgagttctgctgggggtcacatctttcctgagtttcagtgtcaggatgcatggcctccttaggtgggaaggcctgctgtggagggtcctgtcctgggaatttgctgcccaggctgcttctgagccatggcgtcacctccaggtggtggggtcttgggcccaaggagcagagaagacaccatgtggcccctgattggtcgagtatggcctggctctgagtttgggaggtgtgcagggcatggatggggacccaccagagaaagcacgggccaatgaagccccaggctgcgatttctgatgcgcacttggagagggcgcctggttgggcgcccaccatgcccaagggtaggctatgcaactaccaggtctgcggcagtgcctggcatcaggaccagcctcctttgttggctgtgagctggttggtggccctagcccgtgtccagtgatctctgtgcagccctggggtcatgtggagcagccagtgtaggcaggggaggttatcttgaggtgtgcagtaggcacatcccaggcatcttgcccgagcccagtgacctccctgccctgtccttccagggttcggtggcggggaggcccaagggtaccctgtgtccatgacaggtcagtatttcatgtgaatcccatcacatgggccctcctcctgtccccccagatggtgagcctggaggaagacttgcactgggccttctgtgcgccggccagaggccatcaaccaggtgcccaggtccttttgtactgaagcttgggcccttcctggcaccctggtctccttcatggagctggtgagcccatccgggttcttctggatgtatgcatggggagcggggtgcactgggttgggtcaatgatgagaaccttatattgtcctgaagagaggtgatgacttaaaaatcatgctcaataggattacgctgagtcccagcctaggtgacaattttggaagtggacactgagaatcacaaggaccctggcagggccactgtattttgggctggagacctggaggccctcaagggcctctcacagggacccaaccctgtctctgcactcctccgtgaagcacagcaggctccctgtgcggacttggtgttggcactgtttcccaggggcagggcacattggtggcttttccctgagtccccattcttgccttgtgtctttcagtgagctcttcagctcagaagggccccttcaccttgattagcctaggtgagtgcatcctgctggtgtcatgggccatgagtcaggccgcgtggggtcaccaagggtcagtctttaggacaggagggtttcctcagggagccaacctgtatttccaccggggagggatggtttctacaggagggcggcttccttgggaactggacccaagatgttgccttcctgaagccctgcagggatgacagtggtccaggcagcaaagacttccttcagccccgtgcaggagagctcccagctgagactcagtgcatgtgtcaggcctcgaggattgccgaggccacatgatgggggccacagggcctccggggcaccacgggggtcatgcaagagttctctttccctggagaggggtgcttgaatgagcctatgggattgggccgtggagattcaaggattgtacccaactatgtcccaaaatgggactgaccctgttgagctatggaccatcccatggtgcctctttgagcttggtggggggcagtgctgtttccctgggtttgggtcaaggctgagctctggccagtgcctggtgaggctgtgggccggacctgggactcgtgagctttaggccaagtcgacagcttgtgtcctgctggaggtcaccccttccccatgggtgagtggctggaagagtggaatgtgcggtgggaaggcccgctgttgatggtcctatcctgagaatttgctgcccagactctctgtgccatggggtcatgtccagggtggcagggtcttgggcctagggaaaggaaaggacaccatgtggcccaggattggccaagggtggcccggatctgtgtttgggacatgtgtggggcatggatggggacccaccagagaaagcacatggccctggtactccaggctgtgatttcaggtgtggcttggagagagtgcctgggcaggtgcccaccatgcccagcggcaggctatgcaacttccatgtccacggtggcacatggcttctgggccaggctcctcggttggccatgagcatgtcggtgaccctgtcccatgctcagtggtcctggggcagccctgggatcgtgtgaaggagaagtcagagggggcactggatgtgccctcaaggtctgcaatagcatgaagaccaggggtcttgcccaagcccagtgatccacctgccctgttttttcagggtttggtgatggggagggccgagagtgccctgtatccgtgacaggtcagtgttccacatggatcccatcacatgggtatcccttaccccattccccacctggaggtatgaggccctgtttggacacatgtcctcctcctgtccatccagatggtgagcctgaaggaagacttgcatcaggaccaatggaccctggcaagtgtccgtcagccaggtgctcagcccctggtgcactgaagctcaggcccttcctggccccttgatctcctgcactgagctgtggtgagcacatccgggtcccgctggatgtatgtgtgggcagggggggtgccctgggttgggtcaatgatgagaaccctatattgtgttgaagagaggtgatgacttaaaattaccatgctcaatgattacgctgaggcccaacctaggtgagaaatttggaggaggatgctgggatcccgagatttccggcagggccactgtattttgggctggagccctggaggccctgaaaggtatctggaggaggcccaactctgtctctgcactcctctgtgaggcagcccaggctccctgtgcgggcttggtgttggcctttctgttccccagtgaagtggcacgtgggtggctcctccctgagccccagttctccccttgtgtctttcagtgagctcttctgccaagggggggcctcctggcattgaccaacataggtgagtggatcctgctggcatcatgggcatgggttcactgagggtcagacttcaggccatgagggtttcctcagggagctgaccccaattcccatcagggagggatggtttctccaggagggcggcttccttgggaatcttacctgaggaggatgccttccctgaagatctgcaggaatgacaatggtccagatagcaaagggttccttcagccccatgcaggacatcgcccagttgagacttggtgtgcaggtcaggccttgaggactgcccaggccacatgaggcgggccagaagggctccagggtgccacgggtttcacttgggagctctcggtccccgggcatgttcctggggggggtggtgatggggtcgggccatggaggttcaaggatctcatcccacctgtgaccctgaatggggctgatcctgttgaacaatgggccatcccagtggcacgtattgagcctggtcaggggtggtgcagtttcaatggggttgggtcaaggttgagatctggccagctcctggtggtgcttcaggccagtcctgtgacccatgggctttgggctaagggggcatcccatgtcccatgggggtcacctgttctccatgtttgagtggcagtaacagtggcattctgaggtgggaaggtccactgtctagggtgttgtaccgggaatttgccaccccgccttcttagccaaggggtcacctccagggtctcgggatcttgggcccaaggaaacgagaagataccatgtggcccttgattggccgagtgtggcccagctctgtgtttgagaggtgtgggatatgaatggggtcccaccagtgaaagctcatggcccaggtccccaggctgtgatttttagtgcacacttggggagggctcctcagtgggtgcccaccacgcccagaggcaggctatgtgactgccaggtctgcaacggtgcatagcttccaggctaccctccttggttggctgggagcgggttggtggccatggcccatgcccagtggtcacagggcaaccctgggatcatgcaggggagctggtgagggcagtggaggtgctctccggaacggaagtatggctcagcccaggtatctggcccaaacccaatgaccagcctgccttgtttctcagggtttggtgatggggagggccaagggtgccctgcatctgtgatgggtctgttccacatagaacccattacaggggatcccttctccacatggagatgtgaggccctatttggacacatatcctcctcctgtccccccagatggtgagcctggaggaagatttgcattgggcccaatggccctgggccagtgtctgtcagccagtttcccagcccctggtgcactgaagctcaggcctttcctggcatcctggcctcctgcactgagctgtggtgagtatatcatggtcctgctggatgcatgtgcagggagggaaggtgccttgggttcagtcagtgtcgagaaccttatattgttctgaagagaggtggtgacttaaaaatcatgctcaataggattacgctgaggcccagcctagttgagaattttggaaggggacagtaggatcccgaagtccctggcagggcccttatattttaggctggagacttcaaggccctgaagggcacctggaggtggctcaacctgtctctgtgctcctccatgaggcagtccaggctccctctgtgggctttctgttggcactctggttccctgggccagggaacgttggtggctcctccctgagcccctgttctccccttgtgtctttcagtgagtgcttctgcccaggcaggccacttggcattgaccggtataggtgagtggatcctgctggggtcatgggtcatgagcaaggccacatgggtcgccgagggtcagccttacagccataagggttttctcagggagcccacctgaattcccaccggggaggcataggttctccaggagggcggcgttttggggaatcagacccaagggggacaccttccctgaagccctgcaagggtgatggtggtccaggcaggaaagggtttttttcagccccacacaaggcagctcctagctgagaatcggtgcttgggtcagacctcaaggattgcccaggccacatgagggcgactgagagcctccggggcaccacaggggtcacgtgggagctctcggtgcctggcgtgtgatgcacaaatggacctcttgggtttgttcatggagattcaaggatcgcaccccaccatgcccctgaatgggatggtccctcttgagaaatgggccatcccagtgggtctcctggagcctggttggggggtggcattgtttccctggggttgggtgaaggcagagttctggccggcacctggtggtgctgcaggtcagcactgggacccgtgggcgttgggccaaaggagagcccgaatcccactgggggtcaccctttttccaacatcaaatgtctggaagggtggcctcctgaggtgggaagtcctgctgttgagggacatgtcctgggaatttgtcactcaagcttcttctgagctttggtgtcacatccagggtggcagggtcttgggtccaagcaaagcagagggcaccatgtgtctcctgattggccaagtgttgctggctctgtgtgggaggtgtgcagagtatggatggggacccacgagagaaagcacgtagcactgcaactccaggctatgatttctgttgcatgcttggagagggtgcctggacaagcgtgccatgcccaggggcaggctgggcaactaccaggtcttcagcggagtgtgacatctgggccagcctccttggttggccgtgacctggttggtggcccggctctgtgcctactggccccagggcagccctgggatcatgcaggggagccattttgaacagtggaggtgctcttggggcctgtagtatggcacagcctaggtgttttgctcaagcccagtgacccacctgccctgtcctctccgggatcggtggaagggagggccaaaggtgctccgtgtacttgatgagtcagtatttcacattgaactcatcacatgtgtccatggagggtgagcaagggtgagatggcactgctgacccccttccccacgtagaggtcagtttggacacttgtcttcctcctgtctccccacatggcgaccccagaggaaaacttgtgttgggcccgctgtcactgggccaatgtcagtcagccaggtgcccagcccctggtgcgctgaagcttgggcccttctggcacccttggctcctgcactgagctgtggtgagcccatctgggtcctgctggatgcatgtgcagggagggggatacctgggttaggtcgattatgagaaccttatattgtcctgaagagaggtgatgacttaaaaatcatgcccaataggattacgctgaggcccagcctaggtgagagttttggaagaggatgctgggattctgaggtccctgacagagtaaatgtattttgggctggagaccttgaggccctgaagggcatctggtgggcccacccctatctctgtgctcctccgtgaggcagcccaggctccctgtgctggcttggtatctgggctccggatccctggttatggggcatgttggagtctccttcctgagtccccgttctcccctgtgtcttttggtgagctcttctgcccaagtggtccccgcggccttgagcggcataggtgagtgcatcctgtttcggtcatgggccatgagtgatgcagcatggggtcctcgacattcagccttcgggccactagggttttctcaggctgccaacctactccccaccagggagcaatggtttctccaggagggccacttccttgggaatctgacccaaggagcacatctttcctgaagccctgcaggggtgacagtggtccaggcagcaaagggttccttcagcccaatgtagggcagctcccagctgaaactcggtggacagctcaggcctggagtactgtccagggcacatggggaggaggggcacagggaatgtggcgcaccctagaggttacactggagttctctctccctggagaggggtgagtgattgggcccacacagtcaggctgtgaagattcaaggaatgctccacacccatggccttgaatgggaccaaccctgttgagcagtgggccatcttatggtacctccttgagtctggtgagggatggcactgtttcagtgaggttgggtcaagactgagctctggctggcacctggtgctgctgcaggccctgggacttgggggccttcagtcaagggggcagctctgatcctgctggggacaaaccttccttgaggtccagtggtgaagagtgtcctcctaaggtgggaaggcctgctgtcaagggaatttgccacccaggctgcttctgagccttggggtcacctcagggtggcagggtcttgtgcccaaggaaaggagaagacaccatctggttcctgattggctgagtgtagccgggctctgtgtgtcggagttgggcagggcatggatggggacccaccagagaaagtgtggcccaggggccccccaggcttggagagggcaccagggccggtgcccacaatgctcaggtgctggctctgggagggccaggtctgcagcggcttttggcatctggccaaccaccttggttggccaggagctggttgatggccctgtcctgtgtcctgtgccctgtgccctgtgtccctggtatggccctggggtcatgtgtgggagctggcctgagcagtggaggtgctcttggggcctgcagtagggtacagcctaggcatcttgcctgagccagcactgtcttttgctttccctgtctttccagggtttggtggcagagagggcaaaggatgccccacatctgtgttgggtcagtgttcagcatggatcccatcacatgggtatcccttagccccttccctgcattgatatgtgaggccctggttggacacatgtcctccttctgtccctctagatggtgagcctggaggaagatgtgtgggacccgcaggccgagggccagtgtctctcagccaggtgctcagcccccagtgggctgaaactctgacccttcctggcaccctgctctcctgcactgtgctgtggtgagcacatccgggttccactggatgtttgtgcagggagggggttccctgggttgggtcaatgatgagaacagggccacatgaggggggccagaggggctacagagtgccatggggtaacaagggagctcttggtccctggagtgtggtgtgtgaatgggcccatggggttgggtagcagagattcaaggatcctgctctacccatggccctgaatgtgaccatcgctgttgagcaatgggccatcccagtgggtctcctggggcctggttggggggcggagttgtttccctgggattgggtcaaggttgactctggctggcacctggtggtgttgcaggtcagccctgggactcatgggctttgggccagggacagcccgcatcccgctgggggtcacccaagtgttgtgaagggtggcctcctgagttgggaaggcccgctattgaggcatctgtactgggaatttgttgctcacgctgcatgggagccatggtatcacctccagggtggcagtcttgggaccaagcaaaggagggggcagcatgagactccggattggctatgtgtgactggctatgtgtcttggaggtatgtggagtatggatggggacccaccagagaaaacaagtgaccctgaggccccatgctgtcttttctggtgcctgcatggagagggtgcctgtacgcatgcccaccatgcccaggggcaggctgtgccactgtcaggtctgcagtagcatgtggcatctgggccagcctccttggttggctgtgacctggctggtggcccggacctctgcccagtggtcccagggcagccctagggtcatgcggaggagcagttttggccagtggaggtgcccttgggtcctgcagtcgtgcataccctgggcgttttgcctgagcccagtgacctacctgccttgtccttcccgggttcggtggcagggagagacacttgcataggtgatgagtcagtatttcgcatggatctcatcacatgtgtccatggagggggagcaagcgtgagctggcacccaacacccctttctccacatggagggtggtcacatgttctccacctgttcccctagatggtgagacttctgttgggcttgcttttcctgggccagtgtccatcagccaggtgctcagccatcggtgcgctgaagctccagcccttcctggtgccctgatctcctgcactgagctgtgatgagtacatccgggttccactggatgcatgtgcgggaaggggggtgccctgggttgggtcagtgatgagaaccttatattgtcctgaagagaggtgatgacttaaaaatcatgctcaataggattacgctgaggcccagcctgggggagaattttggaaaaggatgctgggatcccagggtccccaacagggccactgtattttggacctgggacctggtggctctgaagggcatctggaggtggcccaacctgtctctgcactctagtttccctgtgtgggcttggtgtcggtgctccagttccctgggggcagggaatgttgatggctccttcctgagtccctgttctcgcctttgtctttcagtgagctctttcacctaggagggccccttggcattgactggcataggtgagtggatcctgctggtgttatggatcatgagccagaccatatggggtccccaaggatcagcctttgggccacaagggttttctcagggagctgacctgaatttccacctgagacggaaaggttctcctggaaggcaggctttttggaatcggacccaaggaggacaccttctctgaagccctgaaggggtgatggtggtccaggcaggaaagggttccttctgcctaacataggacagtgcctagttgagactcggtgctgcagtaaggccttgaggactgcccaggctacatgaggggggccagaggggctacggggcaccacagggttaatggtgacctcttggtccccagagtgtggtgcgtgaatggacccatggtgttgggttgtggagattcaaggatagtgccccacctatggccctgaatgcaactgtccctgtttagcaatgggccatctcagtgggtctcctggagcctggtggggggcagagttgtttccttgtgactgggttaaggtagagctctggccagcacctggtggtgtggcaggtcagccctgggactcttgggcttttgaccaaggggcagcctgtatcccgctgggggtcatcctatctctgaggtcaagtgtcgtgaagggtggcctcctgaagtgggaaggctcgctgtcgagggacctgtcctaggattttattgctcaggctgcttctgagccatggtgtcacctctagggtgatggggtcttgggaacaagcaaaggggagggcaccatgttgctccggattgggcaagtgtggcccagctctgtgtgtgtgaggtgtgcagaacatggatggtgacccaccagagaaagcacatggccctgtagctctaggttgtgatttccgtgcacacttggagacagcatcttgatgtgtgcccaacacgcccaggggcagactatgcgatagccaggtctgcagcggtgtgtggcatctgggccagccacctttgttggccatgagctggctcatggccctgacccatgcccactggtgtcagggggccctggcgtcgtgtgaggagccatctgtggcagtggaggtagactcagggcctgcagtatggcgcaacccatgcattttgcctgagctcagtgacctacctgccctgttcctccagggtttggtggcagggggagccaagggtgccccacattggtgacgagttagtacttcacatggatctcataacatgtgtccgtggagggcaagcaaatgtgagcccgcacccactactgccttccccacatggaggtcagtttggacacatatcatcctgctgtcccccaaatggtgagaccgaagaagacttgccctgggccctctgttcttgggccagtgtcagtcagccaggtgcccagctctaagtgcgctgaagcttgggcctttcctggaatgctcggctcccgcactgagccagggtgagcacatccgggtactgctggatgcatgtgtggggcaggggtgcgccctgggttgggctgatgatgagaaccttatattgtcctgaaaagaggtgatgacttaacaatcatgctcaataggattacattgaagcccaggataggtaagaattagggaagatgatgcagggatcccaagatctccagctagaccacacttattttgcactggagaacttgagaacttgaagggcatctcaggggagcccaaccctgtctctgagctccttcgtgaggcagcccaggctccccttgcgggcttggtgtctgtgctccgcttctccagggacagggcaatttggtgttccttcctgaatgctccttcttccctgtgtccttcagtgagctcttctgcccaggtggggtccctagctttgagcggcataggtcagtgcatcctgttggggtcatgggccatgagtgaggcagcatggggttggtgagagtcagccttcaggccactagggttttctcagggagccaaccgattactcaccgggagggatggttcctccaggagggtcacttcttgggaatctgaccctaggagcacacatttcctgaagctcggcagggagatggtggtccaggcaggaaagggttccttcaacctaacgtagggcagttcccagctgaaactaggtgggcaggtgaggcttgaggactgcccagtccacatgaaaggggccacaggggctttggggtgccctgggagtcatgctggagttcttcccccaagagggatgggtgatagggtccacgtggtcaggctgcggagattcaaggaatgccacccacccatggccctgaatgggaccaaccctgttgagcaatgggccattttcggcatgtttcaatgcagttgggtcaaggctgagcgctggctggtgcctggtggtgctgcaggccggccctggggctcatgggctttatgccaagggggcaactcccatcccactggggtaatcccttccttgaggtccagtggtgggaagggtggcctcctgaggtgggcagacctgctgtcaagggacctgtcctgggaatttgccacctaggctgcttctgagccatggggtcacctccaggatggcggggtcttcagcccaaggaaaggagaggacaccatgtggtttctgattggctgagtgtggcctggctgtatgtgtgggaggtgtgcagggcatggatggggactcatcagagaaagaatgtggccctggaggcccccaggctttgatttctggtgtgtgcttggagtgggcaccagggtggccctaccatgcccaggggcaaggtctttgcctgccaggtctggagtggctcctggcatcaggaccaccctccttggctcaaccaaccttcagcaggttggctgccttggcccgtgccccatggtcccggtacgaccctggggttgttcgggggatctggcccaggcagtggaggtgctcttggggcccacagtagggcacagcccaggcctcttgccccagcccagtaacccacttgccctgtctttccagggttttgtggcagggaaggccaagggtgctctgcgtccatgttgggtcagtgttctgtaaggattccattacaagggtatcccctacccaccttccctacattgatacatgaggccctggttggacacatgtcctcctcctgtccctacagatggtgaccctgaagaaagacttcagttgggcctgaaggccccgggccagtgtccatcatccaggtgctcagctcccagtgcactgaagctcagacccttcctggttccctggtctcttgcactgagctctggtgagcacaactgggtgctgctggatgcatgcatggggaggggggtgccctgggttggggtggtgatgagaaccttgtattcttctgaagagaggtgatgacttaaaaaccatgctcaataggattacacttaggccgaacctaggtgagaatgttggaagaggacgttgggatcctattatccctggcagagccactgtattttgggctggagacctggaggccctgaaagggcatctggagggggcccaaccctgtctctgtgctcctgcatgagggtccccaggctccctgtccagccttggtgttggtgctctggtaccctggggatggaacaagttggtggctctttcctgagcccccattctccctttgtgtctttcagtgagcttttctgcccaggtgggcaccctggcattgattagcctccttggttgtccatgacctggctggtggcccgatcctgtgcccagtggtcccagggcagccctggcatcatacggggcagctgttttgggcagtggaggtgctctccaggcctgaagtatggcacagcctgggcattttacctgagaccagtgacctgcctgccttgtccttcctgggttcggtggcagggagggccaagggtgccctgcgtcagtgatgagtcagtattttgtgtggatctcatcacctgtccatggagggaaagcaagcatgagctggcacccaacacccccttctccgcatggagggtggtcacatgtcctccacctgtgcccccagatggtgagacttgaggaagacttccactgggcctgcttttcctgagccagtgcccatcacccaggtgctcagtccctggtgcactgaagctccagcccttcctggcgccctggtctcctgaactgagctgtggtgagcacatccgggtttcactggatgtttgtgcggggagggggttctctgggttgggtcaatgatgagaaccttatattgtcctgaagagaggtgatgacttaaaaatcatgctcaataggattacgctgaggcccagcctaggggagaattttggcagaggatgccgggatcccaagatttccgggagggccacttgtattttgggttggagacctggaggccctgaagggcgtctggaggtggcccagtgctttctttgcgctcctctgtgaggcagcccaggctccctttgtgggcttggtgtttgcgctcctcttctccagtgatggggcacgttgggggctcctccctgagtcctggttctccccttgtgtctttcagtgagctcttctgccaagcggttcccctggcattgaccaacataggtgagtggatcctgctggcatcatgggctatgagctaggccgcatgggtttgctgagggtcagacttcaggccccaagggtttcctcagggaaccgacctcaattcccaccatgtgactgccaggtttgcaacagtgcatagcttccgagctaccctccttggttggccgggagctggttggaggctgtggcccatgcctagtagtcacagggcaggcagactgccctgttttttcagggtgtggtgacggggagggccaagggtgccctgcatccatgatgggtcagggatttcaggagggatggtttctccaggagggcagcttccttgggaatcttacccaaggaggatgtcttccctgaagccctgcaggggtgacgatggtccagatagcaaaggtttccttcagccccatgcaggacatcacctagttgagatatggtatgtgggtcaggccttgaagactgcccaggccacctgaggggcccagaagggctctggggtgccacaggtgttatgtaggagctctcagtccccagacttgtttcgtggggttggtgacggggttgggttgtggaggttcaaggatttcatcccacctgtgaccctgaatggggccaaccctgttgagcaacaggccatcccaatggcacgtattgagcctggtggggtgtggtgcagtttcaatagggttgagtcaaggctgagatccatctggtgcttggtgctgctgctggccagccctgggacccgtgggctttgggctaagggggtagcccacatcctattgagggtaacccattctccgagtttgagtaacggttaacagtggcattctgaggtgggaaggcccactgtctagggtcctatactgggaatttgccaccccgggttcttctgagacaagtggtcacctccagggtcatggggtcttgggcccaaggaaaggagaagataccatgtggcccttgattggctacatgtggcccaggtctgtttgggaggtgtgtgggatgtggatggggtcccaccaatgaaagcacatggcctgggtccccaggctgtgattttcagtgcacacttggagagggtgcctcggcgggtacctaccacatccatgggcaggctatgtgactaccaggtttgcaacagtgcatagcttccaagctaccctccttggttggtcgggagctggttggaggctgtggcccatgcctagtggtcacagggcaggcagacggccctgttttttcagggtatggtgatggggagggccaagcatccatgatgagtcggtgttccacatggaacccattacgtgggtatctcttaccccttcctcatatggagatgtgaggccctatttggacacatatcctcctcctgtacccccagatggtgagcctggaggaagacttgcgttgggcccaaaggccctagaccagtgtctgtcagccaggttcccaacccccgatgcgctgaagctcaagcctttcctggcaccctggtctcctgcactgagctgtggtgagtatatcctggtcctgctggatgcatgtgcagggaggtgggtgccttgggttgggtcaatgatgagaaccttatattgttctgaagagaggtgattatttaaaaatcatgctcaataggattacgctgaggcccagcctagttgagaattttggaggaggacactgggataccgaagtcccccgcagggactctgtattttgggctggagaccttgaagccctgaagggcatctggaggtggcccaacctgtctctgtgctcctccctgaggcagcccaggctccttttgtgggcttggtgttggggctccagttccccaggtcagggaatattggtagctctttactgagcccctgttctccctttgtgtctttcagtgagctcttctgcccaggcgggccccctggaattgatgggtataggtgagtgcatcctgctggggtcatgggccatgagccaggccacgtggggtcaccaggggtcccccttctggccatgagggttttctcagggaaccgacctgaattaccactggggaggcataggttctccaggagggcggctattttgggaatcggatccaagggggacaccttccctgaagccctgtgggtgtgatggtggtccaggcaggaaagggtcccttccaccccacacagggcagctcatagctgagagttgatgctcaggtcaggcctcaaggatttcccaggccacatgagggggacagaggagctctgggtgccacgggggtcacataggagctctcagtattcggtatgtcatgcacaaatgggcctcttgggttggattgtggagattaaaggatcgcgcaccaccgtggccctgaataggaccatccttattgagcaatgggccatcccagtgagtctcctggagcctggtggaggggagggggtggcattgtttccctggggatgggtcaaggcagagctctggccagcaccttgtggcttctgcaggtcagccttgggactcatgggcattgggccaagggggagcccgcgtcccactgggggtcaccctttttccgacgtcaagtatctggaagagtggcctcctgatgtgggaaggcctgctgtcgagggacgtgtcccaggagtttgtcgctcaagtttcttctgagctttggggtcacatccagggtggcggggtcttgggcccaagcaaagcagagggcaccaagtgtctcctgattggccatgtggctgtctctgtgtgtgggaggtttacagagtatggatggggacccaccagaggaagcacgtggccctgcagcaccaggctgtgatttctgttgcacacttggagaggttgcctggacacgtgcccttcatgcccagtgacagactatgcaactaccaggtctgcagcagggtgtgacatctgggctagcctccttggttggccgccacctggctggtggcccggatctgtgcccaacagtcccagtgcagcactggggtcatgcaggggagctgttttggacagtggaggtgctctcggggcctgcaatatgatgcagcctgggcgttttgctcaagcccagtgacccacctgccctttcctttctgggttcagtggaagggagggccaacagtgtagtgcgtacttaacaagtcagtatttcacattgaactcatcacatgtgtccatggagggcaagcaaaggtgagctggcacccccgacccccttccccaaacggaggtcagtttgggcacacgtctccctcctgtctccccagatggtgaccccggaggaaaatttgtgttgggcccactatccctgggccaatgtcagtcagctaggcacccagcccccagtgcgctgaagctcaggaccttcctagtgccctcggctcctgcactgagctctggtgagtccatctgggtcctgctggatgcatgagctgggggcgggagggtgccctgggttgggtcagtgatgagaaccttatattgtcctgaagaaaggtgatgacttaaaaatcatgctcaataggattacactgaggcccagcctaggtgataattttggaagaggatgctggaattctgaggtccctgacagagcagctgtattttgggctggagaccttgaggccctgaagggcatcttgtgggcccacccctatctctgtgctcctctgtgaggcagcccaggctccctgtgctggcttggtatccgggctctgggtccctggtgacggggcatgttggaggctccttcctgagcccctgttctcccttgtcattcagtgaactcttctgcacaagtgacccccccagccttgagcggcataggtgagtgcatcctgttttggtcatgggccatgagtgatgcagcatggggtccctgacattctgcctttgggccaccagggttttctcaggctgccaacctactccccaccagggagcgatggtttctcaggagggctgcttccttgggaatctgacccaaggagcaagtctctcctgaggccctgcaggggtgacagtggtccaggctggaaagggttccttcagcccaatgtagggcagctcccagctgaaactcagtgggcaggtcaggcctcgagtattgcccaaggcacatgggggagtgaggcacgggggatacagtgcgccgtggaggtcacactggagttctcccctccctggagagggatgagtgactgggtccacacggtcaggctgtggagattcaaggcatgctccacacccatggccttgaatgggaccaaccctgttgagcaataggccatcttagtggcacctccttgagcctggtgggggacggcactgtttcaatgaggttgggtcaagagtgagctctggctggcacctggtggtgctgcaggccctgggacttgtggactttgggccaagggagcagctctgatcctgctggggacaagccttccttgaggtccagtggtgaaaagagtgtcctcctgagatggcaaggcctgctgtcgagggacctgttctaggaatttgctgcccaggctgcttctgagccttggggtcacctcagggggtggcagggtcttgagcccaagaaaggaaaagacacgatgtggttcctgattggctgagtgtgacccggctctgtgtgtcagagttgggcaggacatggattgagacccaccatagaaagcatgtgatcctggaagcccctaggcttggagagggcaccagggccagcgcccaccacgcctaggtacgatctctcggacttccaggtctgcagcggctcttggcgtctgggccagcatgcttggttggccaggggctggttggtggccctgtcttgtgccctgtgtccccggtatggccctggggttgtgtgtggtagcaggcctgggcagtggaggtgctcttggggcctgcagtagggtgctgcccaggcatcttgcccgagccaggtgacacgcttgccctgtctttccagggtttggcggcagggagggccaagggtgcccagtgtccgtgagggatcagtattcagcatggatcccatcacatgagtatcccttagccccttctctacattgatgtgtgaggccctggttagacacatttcctcctcctgtccctccagatggtaagcctggaggaagacttgtgttgggcccacaggccccaggccaatgtctgtcagccaggtgctcagcctctggtgcgctgaaactctgacccttcctggcacactggtctcctgcactgagctggggtaagcacatctgggttgcactggatgtttgtgtggggagggggttccctaggttgggtcaatgatgagaacctgatattgccctgaagagagatgatgacttaaaaatcatgttcaataggattacgctgaggcctagcctaggtgagaattttggaagcagatgctgggatcccaaggtcccttgcagggccatcgtatgttgaactggagacctggaggctctgaagggcatctggaggtcgtgcaacctgtctctgcactcctctgtgaggcagcccaggctccctgtgtggggttggtgttggtgctatggttccctgggggtggggaacattggtggctccctccagagcccctgttctcaccttgtgcctttcagattttccacctaggaggtccacctggcattgactgacataggtgagtggatcctgctggggtcatgggtcatgagccagaccatggggggatcccagagattcagtctttgggcaacagttttctcagggagcagacctgaatttccacctgggagggaagggttctcctggagggcgacttttttgggaatcggacccaaggaggatgccttccctgaagccctgccggggtgatggtggtccaggcaggaaagttccttctgctcaatgcagggcagcacccagctgagactcggtgctccggtaaggcctccagaactgcccaggtcacataaggggggccagaggggctacgaggtgccacggggtaacaggggagctcttggtccccagagtgtggtgcatgaatgggcccattccgttgggtctcagagatttaaggattgcaccacaccatggccctgaatgcaaccgtccctgttgatcaatgggccatcccatgggtctcctggagcctggtgggaggcagtgttgttttcctggggttgggtcaaggcggagctctggctggtacctggtggtgctgcaggtcagccctgggacttgtgggctttgggccaaggggcatcccgcatcccgctgggggccaccctttctccatggtcgagtgtcgtgaagggtggcctcctgagttgggaaggcttgctattgaggcacttgtactgtgaatttgttgctcaggctgcttgggagccatggtgtcacctccagggtggcagggtcttgggaccaagcaaaggagtgggcaccatgtcactgcagataggccatgtgtgactggctctgtgtctgggagatatgtggagtatgaatggggacccaccattcatagagaaagcaagtggccctgcagcccgaggctatgatttccggtgcacacttggagagggtgcctttacacccaagtaccaggctcagaggtaggctatgccactatcaggtctgcagtggcacgtggcatctgggccagcctccttggttggccatgacctggctggtggcctgggcctgtgcccagtgttcccagggtagttctagggtgctgcgggggagctgttttggctagtggaggtgctcttgggtcctgcagtacagcacagcctgggcgttttgcctgagcccagtgacctgcctgccttgcccttcccaggatcggtggtagggaagaccaggggtgcccggcataggtgatgagtcagtatttcacatggatatcatcacatgtgtccatggagggggagcaaacatgagctggcacccgccacccccttctccacatgaagggtggtcacacgttctccatctgttcctccagatggtgagacttctgtcggcctcgcttttcctgggccagtgtccatcagccaggtgctcagccccagtgcactgaagctccagcccttcctggcgccctggactgagctgtggtgagcacatccgggttccactggatgcgtatgtgggaaggggggtgccctgggttgggtcaatgatgagaaccgtatattgtcctgaagagcggtgatgacttaaaaataatgctcaataggattacgctgaggcccaccctaagtgagaaatttggtaggggatgttgggatcccgagatttctggcagggccactgtagtttgggttggaggcctggaggccctgaagggcatctggaggtggctcaactctttctctgtgctcctccgtgtagcagcccaggctccctgtgcgggcttggtgttgttgcttctgttccttgggggcagggcatgtgggtggctcctccctgagccccagttctccccttgtgtctttcagtgagctcttctgccaagggggtcctcctggcattgaccaacataggtgagtggatcctgctgctgtcatggtccgtgagccaggctgcttggggttgccaagggtcagacttcgggccatgaaggtttcctcagggagctgaccctaattcccatgagggaggcatggtttctccaggaggtcagcttccttgggaatctgtgacttgacagggttgagtcgcagaggttcaaggatctcatcccacctgtaaccctgaatggggcccaccctgttgagcaactggccatcccagtggcacatattgagcctggtggggggtggtgcagtttcaatggggttgggtcaaggctgagatatggctggtgcctggtggtgctgcagtccagccctgggatccgtgggctttgggctgagggggaagcctgcatcctattgggggtaacctgttctccaaatttgagtgattggtgggaaggcctactgtctgaggtcctgtactgggaatttgccacctcagcttcttctgagccatagggtcacctccagggtcatggggtcttgggaccaaggaaaagagaagataccatgtggcccttgattggccgagtgtagcccagctctgtgtttgggaggtgtgtgggatgtggatagggtcccacctgtgaaagcatgtggcccgggtccccaggctgtgattttcagtgcacacttggagagggcaccttggtgggtgcccaccatgtccaggggcaggctatgtgactgccaggtttgcaatggtgtgtagcttccttctaccctccttggttggctgggagtgggttggttgctgtggcccatgcccagtggtcacagggcaggcagactgccttgttttttcagggtatgctgacagggagggccatgggtgccctgcattcatgatgagtcagtgttccacatggaacccattatgtgggtatctcttattccttctacatatggagatgtgaggccctatttggacacatgtcctcctcctgtacccccaggtggtgagcctggaggaagacttgcattgggcccaatggccctggaccagtgtctgtcagccaggttcccagcccccgatgcgctgaagctcaagcctttcctggcaccctggtctcctgcactgagctgtggtgagcatatcctggtcctgctggatgcatgcgtggggaggggttgtcctaggttgggtcaatgatgagaaccttataatgttctgaagagaggtgatgacttaaaaatcatgctcaataggattacgctgaggcccagcctaggtgataattttggaagaggacactgggtcccgaagccccctgcagggcccctgtgttttgggctggagaccttgaggccctgaaaggcatctggtggacccaactctatctctgccctcctcaatgaggcagcccagcctccctgtactggcttggtatccgggctccgggtctctggggacggggcacattggaggctccttcctgagcccccattctctcctgtgtctttcagtgagctcttcggcccaagtggtccccccggccttaagcggcataggtgagtgcatcctgttttgatcatgggccatgagtgttgcagcatggggtccccgacattcagccttcaggccactaggcttttctcaggctgcaaacctactctccaccagggagcgatggtttctcaggagggccacttccttcggaatctgacccatggagcacgcctttcctgaagccctgcagaggtgacagtggtccaggcaggaaggggttccttcagccccaatgtagggcagctcccagctgaaacttggtggacagatcaggcctggagtactgcccagggcatatggggaggagggacacagggaatgtggcgcaccctagaggtcacactggagttctgtctccctggagaggggtgagtgattgggcccacatggtcaggctgtggagattcaaggaatgctccacaccgatggccttgaatgggaccaaccctattgagcaatgggccatcttagtggcacctccttgaacctggtgggggatggcactctttcaatgaggttgggtcaaggctgagctctggctggcacccagtggtgctgcaggctggccctgggacttgtgggctttgggccaagggggaagcttccatcctgctgggaacaacccttccttgaggtccagtggcaggaaggggggcttcctgaggtggaaagccctactgttgagggacctgtcctgggaatttgctgtccaagctgcttctgagccatggggtcacctctagggtggtggggtcttgagcccaaggaaaggagaggacaccatgtggttcctgattggctgagtgtggcccggctctgtgtgtcggagttgtgcagggtatggattgggacccaccagtgaaagcacatggccctggaggtccgcaggcttggagagggcaccagatctggcacccaccatgcccaggtacaggctctgggactgccaggttgcagcagctcttggcatctgggccaccctccttggttggccaggagctagttggtggccctgtcccatgccccatgtccctggtatggccatggggtcatgcagaggaaccggccctggcatggaggtgctcttgcaacatgcagtagggtgcatcccaggcatcttgcctgagccaggtgacccgcttgccctgtctctccagggtttggtggcagggagggccaagggtgccccgtgtccatgttgggtcagtgttcagcatggatcccattgcatgagtatcacttagctccttcccagcattgatatgtgaggccctggttggacacttgtcctcctgtccctccagatggtgagcctggaggaagactcgtgttgggcccacaggccccaggccagtgtacgtcagccaggtgctcagcccatggtgtgctgaagctctgacccttcctgactccgtggtctcctgcactgagctgtgatgaccatatccaggtcctgctagatgcatgcgtggggaggcagggtgccctgggttgggtcaatgatgagaaccttgtattatcttgaagagaggtgatgacttaaaaatcatgctcaataggattacactgaggcccagactaggtgagaattttggaagaggatgctgggatcctgaggtccccaacagggccaccatattttgggctggagacctggaggtcctgaagggcatctgtagggggcccaaccctgtctctgcactcctccctgaggcagcccatgctccctattcgggatcggtattggtgctccacttccctgggggcaggacacgtgggtggctactccctgagcccccgttctccccttgtgtctttcagtgagctcttccaaacaggtgggctccctagcattgaccgacagaggtgagtggatccttctgggattatgggccatgagccaggccatgtggggtccccaaggttcagcctttggatcccgagagttgtctcagacagccaacctgatttgccacctgggagagatggcttctccaggagggtgggtttttgggaattggacccaaggaggacgccttccctgaagccctactgggatgatggtggtccaggcaggaaagggttccttcacccagctgagactcggtgttccagtaaggcctcaaggacctccctgccacatgaaggggcccagaggggctacgaggcaccacaggagtgacaggggagctcttggtccccagagtgtggtacatgaatgggcccatggggttgagtcgcagagattcaaggatgctgcaccacccatggccctgaatgtgactctcctcctggagcctggtggggggtggcgttttttccctggggttcggtcaaggtggaactctggtcagtacctggtggtaatgtaggtcagccctgggactcgtgggctttgggccaacggacagcccacatccctctgggggtcaccctttctctgaggtcgagtgtcgtgaagggtggcctcctgaggtgggaaagcccaatgtcgaaggacctgtactgagaatttgttgcttaggctgcttaggatccatgttgtcacctccagggtggtgggatcttgggaccaagcaaaggagagggcaccatgtggctgccagtggctatgtgtgactggctctgtgtctgagaggtgtgtggatggggacccaccagagaaagcaagtggccctgcagccccaagatgtgatttctggtgcaggcttggagagggtgcctatacctgctcccaccacgcccaggggcaggctttgccactgcaggtctgcagtgccacgtggcatctgggccagccaccttggttggccgtgacctggctggtagcccgtgcctgtgcccagtgttcccagggctgccctggggtcttgctggggagctgttttgggcagtggaaatgctcttggggcctgcagtatggcacagcctgggggcattttgcctgagcccagtgacctgcctgccttgtccttcctgggttcggtggcagggagggccaagggtgccctacattggtgacaagtcaatattttgcatggatctcatcacgtgtccatggaggtgggggcaagcgtgagctggcacgcaccccattctccccatggagggtggtcacatgtactccacctgtgtccctagatggtgagactggaggaagacttccattgggcccacttttcatgggacagtgtccatcagccaggtgctcagcccccagtgcattgaagacccagcccatcctggcaccctagtctcctgcactgagctgtgctgagcacatctggcttccactggaagttttttttgcgaggaggggcttccctgggttgggtcaatgatgagaaccttatattgtcctgaagagaggtgatgacttaaaaatcatgctcaataggattacgctgaggcccaacctaggggagaattttggaagaggattatgggatcccaaggtccccaacaaggccactgcattttgggctagagacctggaggctcttaagagcatctggaggtggcccaacctgtctctgctccttcgtgatgcagcccaggctccctgtgtgggattggtgttggtgctccatttccctggcatggggaatgttggtggctccttcctgagctcctgttctcgccttgtgtctttcagtgagctctgccacccaggacatccccctggcattgactggcataggtgagtggatcctgctggggtcattggtcatgagccagaccatgtggagtccccaaggttcagcctttgggccacaaaggttttctcagggagcagacctgaatttcacccgggagggaagggttgtcctggagggtggcttttttgggaacctaacccaaggaggacccattccctgaagccctgcaggggtgatggtggtccaggcaggaaagggttccttctgctcaatgcagggcaacacccagctaagatgcggtgatctggtaaggcctccagaactgcccaggccatatgaggggggccagaggggctacagggtgccacaggggtaacaggggagctcttggtccttggagtgtggtgcctgaatggacccatgggattgggttgtgtagattcaaggatcacaccctacccacagccctgaatgtgactcttcctcttgagcaatgggccatctcagtgggtctcctggagcctggtcggggggtggtgttgtttccctggggttgggtctaggtggagctctggctggtacctggtggtgctgcagatcatccctgggacttttgggctttgggccaagggacagcccgcatcccgcttggggtcagcctatctccatggtcaagtgtcatgaagggtggccccctgaggtgagaaggcctactgtcaagggatctgtcccaggattttgttgctcaggctgcttctgagccatggcgtcacatccacagtggcagggtcttgggcctgagcatagcagagggcaccatgtcgttctggattggccaagtatggcctagctctgtgtgcgggaggtgtgcagagcatggacggtgacccaccagagaaagcacgtggccctgcatcccaggctgtgatttccaatgcacacttggagagggtgtcttgatttgtgcccaccatgcccaggggcagactacgtgatagccaggtctgcagcctgagccacgtgtggcatctgggccagccaccttggttggccgtgagctggctggtggccttggcctgtggccagtggtgccagggcggccctggggtcgtgtgggggagccatgttgggcagtggaggtgctgtcagggcctgcagtacagtgcagcctgggcatttggcctgagcccagtcacccgcctgctctgttcctccagggtttggtggcggggagggccaagggtgccccgcatccgtgacgactcagtaattcacatggatcacatcacatttttccttggagggcaagcaaatgtgagcccccaccccccactgccttccccacatggaggtcattttggacacatatcctcctctagtccccctagatggtgagactggaggaagacttgcattatgcccgctgttcctgggccagtgtcagtcagccaggttcccagctccaagtgtgctgaagctcaggcccttcctggcaccctcagctcctgcactgagctggggttacatccgggttccactgtttgcatgcaaagggaggggtgtaccctgggttgggctgatgatgagaaccttatattgtcctgaaaaaaggtgatgacttaaacatcatgcttaatagtattatgctgaagcccaagctaggtgagaattttggaagatgaggctgggatcctgagatccccggcagggccacacttattttgggctggaaaatttcaagacctgaagcgcatcttgtgggggggcaatcctgtctctgtgcttctccgtgaggcagcccaggctcccgttgcgggcttggtgcccatgcttcgcttccccaggggtggggcaatttggcatcctcttcctgagccctccttcttccctgtgtctttcagtaagttcttcttcccaggtggggcccctggctttgagcggcatgggtcagagcatcctgtcagggtcatgggccatgagtgaggcagcgtcggttcgtcgagagtcagcctttgggccactggggttttctcagggagccaacaggttacccatcaggagggatggttcctccaggagggtcgcttccttgggaatctgactctaggagcatgcatttcctgaagctctgcagggtgatggtggtccaggcgggaaagggttccttcagcccaacataatgcagttcccagctgaaactcggtggcagatcaggctcaaggactgctcgggccacatgatgggggccacaggggatttggggtgccctgggggtcatgctggagttcttgccccaagaggggtgggtgatagggcccatgcgatcaggctgcggagattcaaggaatgctacccacccatggccctgaatgggactgaccctgttgaacaatgggccattttaatggtgcctccttgagcctggtaggtagtggcattgtttcaatgcggttgggtcaaggctgaactctggctggtgcccggtggtgcccacatgggctttgggccaagggggcagctcatatccctctggggtcaccccttccttgagattcagtggcaggaagggtgttctcctgaggtggaagacctgctgtcaagggacttgtcctgggaatttgccacctaggctgcttctgagccatggagtcacctccagggtggcagggtcttgagcccagggaaaggagacaccatatggtttctgactgggagtgtggcctggatctgtgtgtgggaggtgtgcagggcatggatggggacccatcagagaaagcatgtggccctgtaggcccccaggctttgatttctggtgtgtgcttgcagtgggcaccagggcagccctaccatgcccaggggcaggctctgtgactgccaggtctggagtggctcctggcatgaagaccacgctccttggttggccatgagcaggttggttgccctagcctgtgccctgtggtcctggtgcagccctggggttgtttggggagacagcaccggcagtggaggtgctctcaaggcctgcagtagggcgcagcccaggtgtcttgcccgagcccagtaacccacttgccctgtctttccagggtttggtggcagggagggccaactgtgccccgcatctgaaatggatcagtgttctgcatggatcccatcacaagggtatcccctacccaacttctgtgcattgttatgtgaggccctggttggacacatgtcctcctcctgtccctgcagatgctgaccctggaggaagacttgtgtcgggcccccaggccccaggccagtgtccatcagccaggtgctcagctcccagtgcgctgaagctcagacccttcctggcaccctggtgtccagcactgagctgtggtgagcccatccgggtcctgctggatgcatgaatggggaggggcctgcccagagttgggtcaatgatgagaaccttacattgtcctgaagagagatgatgacttaaaaatcatgctcaataggattacgctgaggcccagcctaggtgagaattttggaagaggacggctgggatcctgagatcccagtcagggtcactgtattttgggctggagacctggaggccctaaagggcatctggaagggggcccagccctgtctctgtgctcctccgtgaggcaacccacactccctgtgtgggcttggtgttggtgctctggttccccagggacagggcgggttggtggctccttcctgagcccctattctccctttgtgtctttcagtgagcttttccacccaggtgggccccctggcattgaccgacataggtgagtgcatcctactgggataatgggccactagatagtctgtgtggggttgctgaggtttagcctttgggccacaagggttttctcaggcagccaacctgaattcccacctgggagagatgggttctccaggaggcagcttttttgggaatcagacccaaggaggacaccttccctgaagccctgcaggggtgatggtggtccaggcaggaaagggttccttctgcccaactcgaggcccaatgcagggcagtgcccccctgagaattggtgctctggtaagggctcgaggactgcccaggccacatgaaggaggtcagaggggctatggggaaccatgggggcaacaggggagctcttggcccccggagtgtggtacatgaatgggcccatggggttgggtcacggagattcaaggattgcatctcacccacggccctgaatgcgaccatccctgttgagcaatgggccatcccagtgggtctcctggggcctggtgtggggtggcattgttttcctggggttgggtcaaggcggagctctgactggtacctgatggtgctgcaggtcagccctgggactcgtgggctttgggccaagaggcagcccgcatcctgctgggggtcgccttttctccgaggttgagtgtcgtgaaggatggcctcctgaggtgggaaggcccactgtcaaggcacctagactaggaattgttcctcaggctgcttgggagccatggtgtcacctccagggtggcgggatcttgggactaagcaaaggaggggacactacgtggctcccaattggccatgtgtggctggctctgtgcctgggaagtgtgtggagtatggatggggacccaccagagaaagcaagtggccctgcagtcccagaatgtaatttctggtgtaggcttggagagggtgcctatatgcatgcccaccatgcccaggagcaggctatgccacttcagggtctgcaggggcacctggcatatgggccagcctccttcgttggctgtgacctgggtggtggcctgtgcttgtgcccagtggtcccagggtagccctggggtcgtgcaggggagccgttttgggcagtggatgtgctctcgggtcctacagtacagcacagcctgggtgttttgctcaagcccagtgacctgcctgccttgtccttcccgggttcagtggcagggagagccaagggtgccccacattggtgacgagtcagtattttgcatggatctcatcacacgtgaccatgaaggacgagcaagcatgagctggcaccagccacccccttctccgcgtggagggtggtcacatgtcctccacctgtgcccccagatgatgagactggaggaagacttccattgggcccacttttcctgggccagtgtccatcagccaggtgctcagcccctggtgtactgaagctccagcctttcctggtgccccagtcttctgcactaagctgtggtgagcacatccgggttccactggatttttgtgcggggagggggttttctacgttgggtcaatgatgagaatcttatattgtcctgaagagaggtgatgacttaaaaatcatgctcaataggattacgctgaggcccagcctaggtgagaattttggaaggggattatgggatgctgaggtcctcagcaaggccactgtattttgggctagagacctggaggctctgaagggcatctggaggtggcccaacctgtctctgcgctcctccatgaggcagcccaggctccctgtgcagggttggtgttggtgctccggttctctggtgtggggaatgttggtggctccttcctgagccctcattctcaccttgtgtctttcagtgagctcttccacccaggagggccccttggcattgactggcataggtgagtggatcctgctggggtcattggtcatgagctagaccgtgtggggtccccgaggttcagccttcagtccacaagggttttctcggggagcagacctgaatttccacctgggagggaagggttctcctggagggtagtttttttgggaatctagcccaaggaggatgccttccctgaagccctgcaagggtgatggtggtccaggcaggagagggttccttctgcccaatgcaggacagctcccagttgagactgagtgctccagtaaggtctccaggactgcccaggccacatgaaggaggccagaggggctatggagcaccactggggtaataggggagctcttggtccctggagtgtggtgtgtgaatggggtttggtcacggagattcaaggatcacaccccacccatggccctgaaagtgaccatccctattgagcaatgggccatcccaccgggtctcctggagtctggtgcagggcgacgttttttccctggggttgggtcaaggtggagctctggtacctggtcatgctgcaggtcagccttgggactcgtaagctttgggccaagggacagctggcatcctgctggggggtcaccctatctctggggtcgaatgtcacgaagggtggcctcctgaggtgggaaggcccattgtcgagggacctgtcccaggattttgttgctcaggcttcttctgagccatggtatcacctccagggtgacagggtcttgggcccaagcaaaggagagggcaccatgtcgctctgagttggccaagtgtagcctagctctgtggtgggaggtgtgcagagcatggctggtgacccaccagagaaagcacgtggccctgcagccccaagctgtgatttccagtacatgcttagagagggcatcttgatgtgagcccaccacacccaggggcagactacgtgactgccaggactgcagtggcacatggcatctgggccagccttcttggttggccatgacctagctaatggccctggcccgtgccttggggtcatgcaggggagccctcttggacagtggaggtcctctcagggcctgcaatatggcgcaggctgggcatttggcccgagcccagtgacctacctgccctgtccttccagggttgggtggcagggagggacaagggtgccccatgtcagtgacaagtcagtatttcacatggatctcatcacatgtgcccatggaggacgagcaagcgggaactggcacccgctacttccttccctacatagaggccattttggacacatgttctccacctctctcccagatggtgagacgggaggaagacttgtgttgggcctgctgttcctgggccagtggccatcagcctgttgcccagcccctgaggcgctgaagctcaggcccttcctcacaccctggtctcctgcactagctgtggtgagcacatccgggtcccgctggatgcatgcaagaggtggttggtctcgtgggttgggtcgatgatgagaaccttatattttcctgaagagaggtgatgacttaaaaatcatgctcaataggattacgctgaggcccagcctaggtgagaactttggaagaggatgctgggatcctgagatcccaggcagggccactatattttggggtggagaactcaaggccctgaagggcctctcagggggtgccaccctgtctctgtgcccctctgtaaggcagcccaggctccctgtgtgggcttggtgtctggtctctggttccccgggggcggggcatgttggtggctccttcctgagcccgctttctcccccatgtctttcagtgagctcttctgcccaggtggggcccatggccttacacgacataggtgagtgtatcctgttggggtcatgggccatgaatgaggcagcatggggccatttagggtcagccttcgggccactagagttttctcagggtgcgaccggggagggaacatttctccagtagggtcacttccttggaaatctgatcctaggagcacgcatttcttgaagtcctgcaaaggtgatggtggtccagacaggagagggttccttcagcccaacatagcgcagctcccagctgaaactcggaaggctggtcaggcctcgaggactgcccaggccacatgaggtgggcaacaggggctctggggcaacctgggggtcacgctggagttctccctctctggacagtggtgggtgattgggcccacgcagacaggccccggagattcaggactgcaccccatccatggccctgaatgggaccgaccctgttgagtaatgggccatctcagtggtacctccttgagcctggtagggggagacactgtttcaatgcagttgaatcaaggctgagctctggctggtgcctggtggtgctgcaggcagccctgagggttgtggtctttgggacaaggggtagctcacatcccactggggtcaccccttccttgagattcagtggccaaaagggtgtcctcctgagatgggaagtcctgctgtcgagggacctgttctgggaatttgccacacaggctgcttctgagccacggggtcacctccagggtggtagggtcttgatcccaaggaaaggagaggacaccatgtggtttcttattgaccaagtgtggcctggctttgtgtgtgggaggtgtaacgcaagatgaggacccaccagagaaagcacgtggctctggaggcccccagggtttgatttccggtgtgtgcttggagagggcaccaggttgggcacccaccacgcccagggcaggctctgcgactgccaggtctgcattggctcctggtgtcagggccagactcattggttggccatgagcaggttggttgccctgacccatccccatggtcccagtgtggccctggggtttttcaggggagccggctcaagcagtggaggtgcgcttagggcctgcagtagggaacagcccaggcatcttgcctgagcccagtaacctgcttgccttgtctttccagggtttggtggccgggagggccaatgatgctctgcgtctgtgttggatcagtgttcttcatggattccatcacgtgggtatcccctacccaccttccccttgctcatacgtgaggccctggttggacacatgtccttctcctgtcaccccagatggtgagccttgaggaagacttgtattgggcccccacaggccccaggccagtgtccgtcagcctggtgctcacccccagtgtgctgaagctcagaccctccgtggcaccctggtctcctgcactgagctgtggtgagcacattcaggttccgctggatgcatgcatggagaggggcttgcccttggttgggtcagtgatgagaaccttctattgtcctgaagagaggtgatgacttaaaaatcatgctcaataggattacgctgaggcccaacctaggtgagtatgttggaagaagacactgggatcccgagatctccaacagggcactgtattttgggttggagacctggaggccctgaagggcatctggaaggaggcccaaccctgtctctgtgctcttccttggggcagcccaggctacctctgcgggcttggtgttggtgctccagttccctggggccagggaacattgctggctccttcctgagcccccattcctcccttgtgtctttcagtgaacttttcctcccagatgggccccctggcattgactggcataggtgagtgcatcctgctggggtcatgggccatcagccaggccatgtggggtcgctgaggttcagcctttgggccacaagggttttctcaggcagccgacctgaattcccacctgggagagacgggttctccaggagggcagcttttttgggaattagacccaaggaggatacctgaagccctgcaggggtgacggtggtccaggcaggaaagggttccatcagcccgggcaaggcagctcctagctgacactcggtgttcgggtcagtccttgaggactgcctgaacacgagggggtccagaggggctctgggtgccacgggggtcacatgggagctctcagtccctagagtgtggtgtgtgaatggacccttagggttaggtcttggagataaaaggattgtgctccacccatggcctggaatgtgaccgtccctgttgagtaatgggccattccagtgggtctcctggagcctgatgggaggtggcgttgtcttcctggggttgagtcaaggcagagctctggcccatacctggttgtgctgcaggtcagccctgggactcgtgggctttgggccgaggggcagcccgcatcccgctggagattaccctatctctgagatcaagcgtcatagagggtgacctcctgagaagggaaggcccactgtcgagggacctttcctaggattttgttgctcaggctgcttggaatccattgtgtcacctccagggtgatggaggtttgggcccaagcaatggagagggcaccatgtgtctcctgattgttcaagtgtgtcggagatatgcggggtatggatggtggcccaccaaagaaagcatgtgactcaagctgtgatttccagtgcatgcttagagagggcgcctgtatgcgtgccccacatgcccggggtaggctatgcaactgccaggtctgcagtggcgcatggcatcttggccagccttcttggttggccatgacctggctaatgaccctggcctgtgcccagtgatcccagggaagccctggtgtcatgcagcggaggcctcttgggcagtggaggtgctcttaaagcctgcagcatggcacggcctgggcatttatcccaagcccaatgaactacctgccctgtccttccagggttcggtggcaggcagggccaagggtgccccgtgttggtgacaagtcagtatttcacatggctctcatcacatgtgtccgtggaagataagcaagtgtgaactggcacgtcctacctccttccctacatggaggtaactttggacacatgttctccacctctctcccagatggtgagaccggaggaagacttgcattgggcctgttgttcctgggccagtggccatcagcctgttgcccagcccctgatgcgctgaagctcgggcccttcctcgcgccctggtctcctgcactgagctgtggtgagcacatccgggtcctgctggatgcatgcacgaggtgattgatcccctcagttgggtcgatgatgagaaccttatattgttctgaagagaggtgatgacttaaaaatcatgctcaataggattacgctgaggcccagcctaggtgagaattttggaagaggatgctgggatcccgagatccctggcagggccactatattttgggctggagaacttgaggccctgaagggcatctcaggggggtccaaccctatctctgtgcccctccatgaggcagcccaggctccctgtgtgggcatggtgtccgggctctggttccctgggggtggggcatgttggtggctccttcctgagcctgctttctcccccatgtctttcagtgagctcttctgcccaggtgaggcccatggccttaagcggcataggtgagtgtatcctgttggggtcatgggccatgaatgaggcagcatggggccatttatggtcagccttcgggccactagggttttctcagggtgcgaccggggagggaatgtttctccagtagggtcacttccttgggaatctgaccctaggagcatgcatttcgtgaagccctgcaaaggtgatggtggtcccggcaggaaagggttccttcagcccaacatagagcagctcccagctgaaactcagcgggctggtcaggcctcgaggactgcccaggccacatgaggtgggcaacaggggctctggggcaacctgggggtcacgctggagttctccctctctggacagtggtgggtgattgggcccacgcagacaggccccggagattcaggactgcaccccatccatggccctgaatgggaccgaccctgttgagtaatgggccatctcagtggtacctccttgagcctggtagggggaggcactgtttcaatgcagttgaatcaaggctgagctctggctggtgcctggtggtgctgcaggcagccctgggggttgtggtctttgggacaaggggccagctcacgtccctctggggtctccccttccttgagattcagtggccgaaaggatgtcctcctgaggtgggaagtcctgctgtcgagggacctgttctgggaatttgccacacaggctgcttctgagccacggggtcacctccagggtggtagggtcttgatcccaaggaaaggagaggacaccatgtggtttcttattgaccaagtgggacctggctctgtgtgtgggaggtgtagggcaagatgaggacccaccagagaaagtacgtggccctggaggcccccaggctttgatttctggtgtgtgcttggagagggcaccagggtgggcacccaccatgcccagggtaggctctgcaatggccaggtctgcattggctcctggtgttagggccagactcgctggttggccatgagcaggttggttgccctcacccgtccccatagtcccagtgcggccctggggttgttcgggggagccggcccgagcagtggaggtgctgttggggcctgcagtagggcatcttgccccagcccagtgacccaccttccctgtctttccaaggtttggtggccagcagggccaatggtgccctgtgtctgtgatgagtcagtgttcttcatggattccatcacatgggtatcccctacccacattcccctcgctcatatgtgaggccctggttggacacatgtccttctcctgtcaccaccccagatggtgagcctggaggaagacttgtattgggaccctacaggccccaggccagtgtctgtcagcctggtgctcatcccccagtgcgctgaagctcagaccctccctggcaccctggtctcctgcactgagctgtggtgagcacatccaggttctgctggatgcatgcatggggagggccttgattgggtcaatgatgagaaccttatattgtcctgaagagaggtgatgacttaaaaatcatgctcaataggattacgctgaggcccaggctaggtgagaattttggaagggagcgctgggatgccaagatccccggcagggccactagccactgtattttatactgaagaacttgaggccccaaagggcatctcaggggtcctagccctgtctctgtgcccctccgtgaggcagcccaggctccctgtgttgacttggtgtccaggctctgcttcctggggatagggcatgttggcagctccttcctgagcccacgttctcccctgtgtcttctattgagctcttctgcccaggtggggcccatgcccttaagcagtataggtgagtgtatcctgttgcggtcatgggccataaatgaggcagtgtggggtcatcgagggtcagccttcaggccactagcgttttctccaggtgcccccggggagggaacattgctccagtagggtcacttccttgggaatctgaccctaggagcacgcatttcctgaagccctgcaaaggtgatggtggtccaggcaggaaagcgttccttcagcccaacatacagcagctcccagctgaaatttggtgggctcgtcaggccttgaggactgcccaggcttcatgatgggggacacagaagctctggggctccctggggctcacactggagttctccctccctgaagagtggtgggtgattgggcccacagtcaggtggcggagattcaaggaatgcccccacccctggccctgaatgggaccaactctgttgagtaatgggccatcttaatggcgcctccttgagcctgttgggggtgggttgctgtttcaataaggttgagtcaaagctgagctctgactgggcgcctggtggtactgcaggccggcccttccttgggccaagggggcagcttgtgtcccgctggtgtcatcccttccttgaggtccagtggtggaaagggtagcctcctatggtgggaaggcctgctgctcagggacctgtcctggaaatttgccatccaggctgcttctgagccatggggtcacctccagggtagtggggtcttgagtccaagaaaaggagaggacaccatgtggttcctgattggccaaggctccttggttggccaggagcaggttggttgccctggcccatgccccatggtcctggtgtggccctggggttgttcaggggagctggcccaggccgtgaaggtgctctcagggcctgcagtagagtgcagcccaggcatcttgccccagcccagtgacccacttaccctgtctttctaaggtttggtggccaggagggccaatggtgccttgtgcccatgttgggtcagtgttctgcatggatccccatcatatgggtattccctacccaccctccctgcactgatatgtgaggccctggttggacacatgtcctcctcctgtcccttcagatggtgagtctggaggaagacttgtgttggacccccacaggccccaggccagtgtccatcagcctggtgctaatcccccagtgctctggagtttggaccctccctggcaccctggtctcctgcactgagctgtggtgagcacatggatgcatgcttggggtgggggttgcccttggttgggtcaatgatgagaaccttatattgtcctgaagagcggtgatgacttaaaaatcatgctcaataggattacgctgaggcccagcctaggtgagaattttggaagaggacactgggctccccggaatggccactgtattttgcgctggacacctgcaggccctgagggccatctggaaggtccaaccctgtctctctgctcctccaggaggcagcccaggctccctgagggggcttggtgtcgggctcctgttccccggggttggggccggttggtggctccttcctgagcccccattctccccttgtgtctttcagtgagctcttccacccgggcgggcccccggcattgactggcataggtgagtggatcctgcttgtgtcatgggccatgaaccggtccatgtggggtcaccaagggtcagcctttgggataagagggtttcctcagggaaccaacctgaattcccatcagagaggtatgggttctccaggagggccgcttttttgggaattggacccaaggaggataacttccctgatctctgcaggagtgacggtggtccaggcaggaaagagttccttcagccccacccagcgcagcgttctgttgagactcagtgctcaggtcaggcctggaggatttctcaggccatctgagggggttagaggggagctctttgtccatggagtgtggtgcttgaatctgcccttggggttgggtcatggagattcaaggatggtgcctcacccatggccctgattggaattgtccattgagaaatacgccattccagtgggcctcctggagcctgatggggggtggtgtttttttccctggggttgagtcgttgatggggactcaccatagaaagcatgtggctctggaggcccccaggctttgatttccagtgcctgcttggagtgggcaccagggccggcacccaccatgcccaagggcaggctctgcgactgccaggtctgcattggctcctggcatcaggaccagcctccttggttggccatcagctgcttggttgccctggcccatgccccgtggtcctggtgtggccctggggtggttgagtggagctggcccaggcagtggaggtgctcttggggcctgcagtagggtgcagcccaggcatcttgcctgatcccagtgacctgcttgccctgtctttccaggattttgtggcagggagggccaagggtgccctgcatccgtgatgggtcagtgttccacgtggatcccattacgtgggtccatagaggatgagcatgcgtgagccagcgcccccttcccacttcttctcatggagctgtgaggccctgtgtggacagctgtcttcctcttgtcccaccaggtggtgagcccggaggaggacttgcgttcggcccgctggtcccagtgtgtccggaattggtgggttcttggtctcactgacttcaagaatgaagctgcggaccctcgctgtgagtgttacagctcttaaggtggcatgtctggagtttgttccttctgatgttcggatgtgttcggagtttcttccttctggtgggtttgtggtctcgctggcttcaggagtgaagctgcagaccttcgcggtgagtgttacagctcataaaagcagtgtggacccaaagagtgagcagtagcaagatttattgcaaagagtgaaagaacaaagcttccacagtttggaaggggacccaagtgggttgccactgctggctggggcagcctgcttttattctcttatctggccccacacacatcctgctgattggtagagctgagtgatctgttttgacagggcgctgattggtgcgtttacaatccctgagctagacacaaaggttctccatgtccccactagattagctagatacagagtgttgacacaaaggttctccaagtccccaccggagtagctagatacagagtgtctattggtgcattcacaaaccctgagcttgacacagagtgctgattggtgtgtttgcaaaccttgagccagatacagagcgcggattggtgtatttacagtccctgagctagacataaaggttctccaaggccccaccagagaagctagatacagagtgtcgattggtgcattcacaaaccctgagctagacacagggtgctgattggtgtgtttacaaaccttgagctagatacagagtgccgattggtgtatttacaatccctgagctagacataaaggttctccaaggccccaccagactcaggagcccagctgtcttcacccagtggatcccgcactggggctgcaggtggagctgcctgccagtcctgcgccatgcgcccgcactcctcagcccttgtgtggttgatgggactgggcaccgtggagcagggggcggcactcgtcggggaggctctggctgcacaggagcccatggagggggtgggaggctcaggcatggcaggctgcaggtcccgagccctgccccgagggaaggcagctaaggcccggtgagaaatcaagtgcagcgccggtgggctggcactgctgggggacccagtataccctctgcagctgctggcccgggtgctaagcccctcattgcctggggccggcagggccggcccgctgctccgagtgtggggcccgccaagcccacacccacccggaactccagctggcccacaagcgccccgcgcagccccggttcccacttgcgcctctccctccacacctccctgcaagctgagggagcaggctccggccttggccagcccagaaaggggctcccacagtgcagcagtgggctgaagggctcctcaagtgccaccaaagtgggagcccaggcagaggaggcgccaagagcaagtgagggctgtgaggactgccagcacgctgtcacctttcatcaggacagtgtctgtcagccaggtgcacagcccttggtgtgctggagcttgggcttttcttggcagcctggtgtcctgcattgagcggtggtgagcttgtccaggtcccgctggttacctgcacggtgacgggggtgccctcggttaggttgatgatgagaaccttattttgtctcgaggagaggttatgtgatgggtgttgtggcagctctttgtatttcattttcttcagtgctttttgtgtgttctctttgtattttttaccgctttgtgtattttactttcacaaaggcagcagcaaatgttttattggtggtggtatttttcatttttatttacttcctaatttgatagtgttttagttggaatacacagtctcattgtagttgttcagaaatatgctttttttctgtacattatatgattgtgcataatttttgccagttttttttttaattggggactacagttgaatgcactgcctatctcctactttactgaaacagattgtatggaaatctaaagacgagaaagtagacaagcacagcagaggacatttattttgatataaccacagaaattcattgatatgaccttatcatattgatggtttttcaaagaaatataaaatctttcgataatggattgtctcagttgcgtttctccttatatcatgttttgccttcaatacaaattgcaatgcttagaaatttaaagaacaccttctgaagtggaagatctagctaaagaattagattggtattggctgaaatgttgcagtaatcacatgatagggttaatacaacatgagttacatgctgagtgctctaaggtagaaagtaggtaacaaggaataacaggtaggtaatgtaagtcgggagaaggaaactctaggacagaatcattagaaaaggcttgacgtcaacagcagtgtatagaatttacagtgtatagaatttacagtgcatagaatttacaataagtgcctttttttgtgctcatcaatgctcttgcttatattgtaggaggagttagttcccttgaagaaatatcaatacaaatttccaaattgcaatgcagagggaaaaaagaatgagaaagtaaaaaatatccaagaactctggaagcatttcaaaaagtgtaaaaatgcatagtgacaatgtcaggagaataaggagataaaggaaaagaaatatttgacacaacaatgacttgagcactttctaaaattaatgatggacagaaacccacatgttcaggaagctcagagagcactctgcagaataaaaatattttacaaatcgacacctttgcatttcatatttaaagtccagaaaatcatagactaagggaaaagcttgataggagcaataggaagaaaaccatcttacctatggagcaacaagaataaaaattgctttgaaattatcttcagaatccatgaaagcaagaagtgagtcagggtgaaatatttagtgttaaaagtaagaaacaaaaaaaagtaccaactttgaattttctgctcatcaaaattattcttcaaaagtgaaggagaaatactctctgagaccaacaaaaattgctagaacttcttgccactacaccaaccttttaataaacgtaacaagaaattcttcagaaaggataaaaatgacataggtcggaaaatctaatttacataaagaaatgaaaagcattggagaagaaatatatgaagaaaaattaaatatatatgtattttttgattcataattgatctttcaacaatttgttcaaaataataacaagattatatttggtgattataggttatggaaaagtgaaatgaatgacagcaatattataagtcatccggttccaagatggccgaataggaacagctccagtttacagctcccagtgtgagtgacgcagaagacagttgatttctgcatttccaactgacgtaccaggttcatctcactggggcttgttggacagtgggtgcagcccatggagtgtaagccgaagcaggacgaggcatcacctcacctgggaagtgcaagaggtcagggaattccctttcctagccaagggaagcgtgacagatggtacctggaaaattgggacactcccaccctaatactgtgcttttccaactgtcttagcaaacggcacaccaggagattatatcccgtgcctggcttggagggtcccacatccacggagccttgctcactgctagcacagtagtctgagatcaaactgcaaggcagcagtgaggctgggggaggggcatccaccattgctgaggcttgagtaggtaaacaaagcggctgggaagctcgaactgggtggagcccaccacagctcaaggaggcctgcctgcttccgtagactccacctctaggggcagggcatagcagaacaaaaggcaacagaaacttctgcagacttaaacatccctgacagctttgaagagagtagtggttctcccagtacagagtttcagatctgagaacagacaggctgcctccttaaatgggtccctgacccccaagtagcctaactgagagacacctcccagtaggggctgactgatacctcatacagctgggtgcccctctgagacgaagcttccagaggaaggatcaggcagcaacatttgccgttctgcaatatttgctgttttgcagcctccactggtgatacccaagcaaacagggtctggagtggacttccagcaaactccaacagacctgcagctgaggatcctgactgttagaaggaaaactaacaaagagaaaggacatccacaccaaaaccccatctgtacgtcaccatcatcaaagaccaaaggtagatgaaaccacaaagatggggagaaaccagagcagaaaaactgaaaattctaaaaatcagagcacctcttctcctccaaaggaatgcagctccctgccagcaatggaacaaagctggacggagaatgactttgacgagctgacagaagtaggcttcagatgatcgctaataacaaacttctctgagctaaaggatgaggttcaaacccatcgcaaagaagctaaaaaccttgaaaaaagattagatgagtggctaactagaataaacagcatagagaagaccttaaatgacctgatggagctgaaaccatggcacaagaactacgtcacacatgcacaagcttcagtagccgatttgatcaagtggaagaaagggtatcagtgattcaagatcaaatgaatgaaatgaagcaagaagagaagtttagagaaaaaagagtaaaaagaaacaaagcctaaaaaagtaaaaaagtaaaacaaagtaaaaaagaaacatgggactatgtgaaaacaccaaatctacgtctgattggtgtacttgaaagtgatggggagaatggaaccaagttggaaaacactctgcaggatattatccaggagaactcccccaacctaggaaggcaagccaacattcaagttcagaaaatacagagaatgccacaaagatactccttgagaagcgtaactccaagacacataattgacagatacaccaaagttgaaatgaaggaaaaaatattaagggaagccagagagaaaggtcaagttacccacaaagggaagcccatcaaactaacagcaaatctctcagcagaaactctacaagccagaagagagtgggggccaatattcaacattcttaaatgaaagaattttcaacccagaatttcatatccagccaaactaagcttcataattgaaggagaaataaaatactttacagacaagtaaatgctgagagattttgtcaccaccaggcctgccctacaagagctcctgaaggaagcactaagcatggaaaggaacaaccagtaccagccactgcaaaaacatgccaaattgtaaagatcactgatgctaggaagaaactgcgtcaactaacgagcaaaataaccagctaacatcacaatgacaggatcacattcacacataacaatattaaccttaaatgtaaatgggctaaattctccaattaaaagacacagactggcaaattggataaagagtcaagacccatcagtgtgctgtattcaggagacccatctcatgtgcagagacacacataggctccaaataaagggatggaggaagatctaccaagcaaatggaaaacaaaaaaaagcaggggttgcaatcctagtctctgatgaaacagactttaaaccaacaaagatcaaaagagacaaagaaggccattatgtaatagtaaaggggtcaattcaacaacaagagctaactatcctaaatatacatgcacccaatacaggagcacccagattcataaagtaagtccttacagacctacaaagagacttagactcccacacaataataatgggagactttaacaccccactgtcaacattagacagatcaacaagacagaaagttaacaaggatatccaggaattgaactcagctctacaccaagcagacctaatagacatctacagaactctccaccccaaatcaacagaatgtacattcttctcagcaccacatcgcacttattccaaaattgaccacatagttggaagtaaagcactcctcagcgaatgtaaaagaatagaaattataacaaactgtctctcagaccacagtgcaatcaaactagaactcaggattaagaaactcactcaaaaccactcaactacatggaaactgaaaaatctgctcctgaatgactactgggtacataatgaaatgaaggcagaaataaagatgttctttgaaaccaatgagaacaaagacacaacataccagaatctctgggacatatttaaagcagtgtgtagagagaaatttatagcactaaatgcccacaagagaaagcaggaaagatctaaaattgacaccctaacatcacaattaaaagaactagggaagcaagagccaacattttcaaaagctagcagaaggcaggaaataactaagattggagcagaactgaaggagatagagacacaaaaaacccttcaaaaaatcaatgaatccaggaactggttttttgaaaagataaacaaaattgatagaccactagcaagactaataaagaagaaaagagagaagaatccaatagatgcaataaaaaatgataaaggggatatcaccaccaatcccacagaaatacaaactaccatcagagaatactataaacatctctatgcaaataaactagaaaatctagaagaaatggataaattcctggacacatacaccctcccaagactaaaccaggaagaaggtgaatctctgaatagaccaataacaggctctgaaattgaggcaataattaatagcctaccaaccaaagaaagtccaggaccagagggattcacagctgaattctgccagaggtacaaagaggagctggtaccatgccttccgaaactattccagtcagtagaaaaatagggaatcctctctaactcattttataaggccagcatcatcctgataccaaagcctggcagagacacaacaaaaaagagaattttagaccaatatccctgatgaacatcgatgcaaaaatcttcaataaaatactggcaaaccgaatccagcaacacatcaaaagctaatccaccacgatcaagttggcttcatccctgggatgcaaggctggttcaacatacacaaatcaataaacataatccatcatataaacagaaccaaagacaaaaaccacatgattatctcaacagatgcagaaaaggcctcgacaaaattcaacagcgcttcatgctaaaaactctcactaaactaggtgttgatgggacgtatctcaaaataataagagctgtttatgacaaacccacagccaatgtcatactgaatgggcaaaaactggaagcattccctttgaaaactggcacaagacaggaatgccctctctcaccgctcctattcaacttagtgttggaagttctggccagggcaatcaggcaggagaaagaaataaagggtattcaattaggaaaagaggaagtcaaattgtccctgtttgcagatgacatgattgtatatttagaaaaccccatcgtctcagcccaaaatctccttaagctgataagcaacttcagcaaagtctcagaatacaaaatcaatgtgcaaaaatcacaagcattcctatacaccaataacagacaaacagagagtgaaatcatgagtgaactcccattcacaattgcttcaaagaataaaatacctaggaatccaacttacaagggatgtgaaggacctcttcaaggagaactacaaaccactgctcaacgaaataaaagaggacacaaacaaatggaagaacattccatgctcatggataggaagaatcagtatcgtgaaaatggccatactgcccaaggtaatttatagattcaatgccatccccatcaagctaccaatgactttcttcacagaattggaaaaaactactttaaagttcatatggaaccgaaaaagagcctgcattgccaagtcaatcctaagccaaaaggacaaagctggaggcatcacactacctgacttcaaactatactacgaggctacagtaaccaaaacagcatggtactggtaccaaaacagagatatagaccagtggaacagaacagacccctcagaaataataccacatgtctacaaccatctgatctttgacaaacctgacaaaaataagaaatggggaaaggattccctatttaataaatggtgctgagaaaactggctagccatatgtaaaaagctgaaactggatcccttccttacaccttatacaaaaattaattcaagatggattaaagacctaaatgttagacctaaaaccataaaaaccctagaagaaaacctaggcaataccattcaggacataggcatgggcaaggacttcatgactaaaacaccaaaagcaatggcaacaaaagccaaaataaacaaatgggatctaattaaactaaagagtttctacacagcaaaagaaactaccatcagagtgaacaggcaacctacagaatgggagaaaatttttacaatctactcatctgacaaagggctgatatccagaatctagaaagaagttaaacaaatttacaagaaaaaaatcaaccccatcaacaagtgggcaaaggatatgaacagacacttctcaaaagaagacatttatgcagccaaagacacatgaaaaaatgctcatcatcactggccatcagagaaatgcgaatcaaagccacaatgagatcccatctcacaccagttagaatggcaatcattaaaaagtcaggaaacaacaggtgctggacaggatgtggagaaataggaatacttttacactgttggtgggatggtaaactagttccaccattgtagaagacagtgtggcaattcctcaaggatctagaactagaaataccatttgtcccagccatcccattactgggtacatacccaaaggattatatatcatgctactataaagacacatgcacatgtatgttcattgtggcactattcacagtagcaaagacttggaaccaactcaaatgtccatcaacgatagactggattaagaaaatgtggcacatatacaccatggaatactttgcagccataaaaatggatgagttcaagtcttttgtagggacatggatgaagctggaaaccatcattctcagcaaactatcgcaaggacaaaaaaccaaacactgcatgttctcactcataggtgggaattgaacggtgagaacacttggacacagggtggggaacatcacacacgagtggctgccgtggggtggggggaggggggagggatagcattaggagatatacctaatgtaaatgacgagttaacgggtgcagcacaccaacatggcacatgtatacatatgtaacaaacctgcacgttttgcacatgtaccctagaacttaaagtatgaaatatatatatatatatatatatatagtcatgagggagagaaaatactcttagttacttggactaacccacgaagtaggacagtataatttgaaaaaggacttggattagttgtaaacgtataatgtaatatccagcacagccactaaaaatgattttgaaaaaagcagtataatcaatatactaacagaagaaaaagcagaatcaggccagacatggtgactcatgtctgtaatcccagcactttgggatgctgaggcaggaagatcacttgagccccggagttcaagtccagcctggcaacgaataagagcccatctctaccctccaccccccccaaaaaaaaaaagaaaaagaaaaagaggccgggcacggtggcttactcctgtaatcccagcactttgggaggccgaggtgggtggatcgcgaggtcaggagatcaagaccatcctgcctaacacggtgaaaccccgtctctactaaaaatacaaaaaaaaaaaaaaaatagctgggcatggtggcgggcgcctgtagtcccagctactcaggaggctgaggcaggagaatggtgtgaacctgggaggcagagcttgcagtgagccgagattgcgccactgcactccagcctgggagacagccgcaagattctgtctcaaaaaaacaacaacaacaacaaaaaaaaacaaaaacaaaaacaaagaaaacgaaaagaaaaagcagaatctttttttttttttttttttttttttttttgagatggagttttggtcttgttgcccgggctggagtgcaatggcacgatttcagctcaccacaacctccacctcccaggttcaagcaattctccgggctcagcctcccgaatagctgggattacaggtgtgcaccaccatgcctggctaattttttgtatgaaaaagcagaatcttatacaatgctcaattaaaatcagggagaggagaaaaagagtagaataccaaaaaagtaacaaattacaaggttgatataaatagaaaacaatcacaaatactgagtatactaatctaagtatatcaataatcactttaaacatcgcttaaaagacagagattgtcagtggattaagaacaagacccaaatatatgttgtctatgagaaatgcactttaaatagctgggcatggtggtgtgcacctgcagtccttaggaggccaaggcggagtgtcacctgagcccaggattttgggactacagtgagctatgatcatgccactgcactctagcctggttgacagaataagacctcatctctatagaaaaaagtaagtaaatctactttataaaggcacaaatatattcacagtaaaggaatagagaaagatatcccatgctaacattaatcaaaataaagtgaaatagccatattaatttcagacacaaccgactttagaacaaggaatattatcagagatcaaaagggacattccttaatgataaagggatcagttttctaagaagacataacaatccttaatgtgtacgcactgaacagcagatcatcaaagtacatgaagctaaatctgatagaactgcatagagaaatagataaattcactcttagagttggaggcattggcatccctctatcagaaatggacaggtttagcaagcagaaaatcagtaagggcataacatgatcaatcatgatcaaaaacttgattcagtcaactatatgtaactgacatctatggaccactttacccaacaacagcagatgacacattttctcacacacacatgaaacattcagcagaatagaccacattctgggctagaaaatgcacctcaacaaatttaaaagaatagaaatcatacaaagtatgttctcagactacaatggaatgaaagtaaacaaaaatcactaaaaaagatagctgaaaaacatgaaaatacttggaggttaaacaacagactgaaataactgaaggtcacagaagtctcaagataaatttttaaaatatttcaaactaaatggaattgaaagcacaacttatcaaaaatttaggaacgcaacaaaggcagtgcctactgggaaatttataccactgaatgtatgttaaaaagaacaaagatctaaataaataatccttcccattggaaagctagggggaaaattcaaattaaattcaaagtaagcaagtaaaagaaataataaaatatgaatacaattctgagtggcctgatatctgatttctggaagctgagttttatgtggctttagaagtttcatgttatgagtgtgaaatggcaagtgaccatggcgattgcttctgatatggccacctcaattacatagagaagggatgatcagtggcatcatcccagttctgcatgataccacaccagtgattctccaaagtcaagaaacctgtatatgttgtccttgtgtttggtgaatctgtggtctatagactacataatgggctatttctggggtactgaccattttgctccattaaggaaaaccatgcatgagccatataactatgggaaacaatgttttcctttttgacacctggcctactctcttcttaggtgagagcaaaggaagagcaccacttggcctgctgcacccagggcaatttataccatccagatatccagcactgaatatgtagcaactccaatccaccatagaacattaatctatctctgataagcatgctaatatctatgattctgcctttgtggggagatgactccatagattaaccccctggcttggggcaatatggagatgttatattgtcttcgacagggaagatgacataaaaattatgttcaataggattatgtggagacttaacataagtgacaaacctaagacaagaagttagaaatccttgtttcttttaggtgaataattttggagcttgagaaaaagacaccattgtggcgaacttgctttgccaaaccctgtgtatgcatttttgggtaaacaacacattttcatcctttaagcattgtttccattatttataattcctaatagtatgagacatttaggactcattccttggttcttcttctctcattgtatctttcattgtatctttcagtgctgcaagagatgcaatcatcccattaatgaaagcagagtgactgccttcgtcacacatacattcaaaatagatcactaggctagtgatgattctctcttaaggctattatgtttactcatttaaaaaatctggatctcagtatagattttcttctcagtgagtgactgacctatctgatatgatgctatgacaaaatctttactttttacctgaatttggtgggattgaaagttgagaacatattaatttattttctgtttcacttgattaataatgcccaatctaacatgcagtgttcacttgggtacatatatacaactacatcaaattttttcttgttttaccttaaaagtgttaagatattgtaatggtatggccagtttactcactggtaaacttttcataacagaaatatcatgccagtggacacaaatatgtaacatcagtaatttgctttcctcatgaaacagagaactgaataagttgatgggtaaactagtatctgaattataaaccccaaatatcatgtgacttcatcattttcagtataatgaaaatacaggctgtgaatgcttccagttggtcctgaaagggcctttgaggtgagtaggttcaccaaagcggcaacatatgtgtcccagtgggcattctactcctcagtaagtgacttgacattctttatggcttcctcatgattaaaacaagtctttttattgaaattttactgaaataatgatgaaacaatgtaatattcttttcatctacatataagagtagacatagattaacctctaccttttttttttttttttttgagacggagtctcgctctgttgcccaggctagagtacagtggtgcgatctcagctcattgcaacctctgcctcccaggttcaagcgattctcctgcctcagcctcctgagtagctgggattacaggcacgtgctaccattcctggctaatttttttgtaattttagtagagacatggtttcaccatgttggtcaggctgttcttgaactcctgaccttgtgatctgcccacctctgcctcccaaagtgctgggattacaggcttgagcccccgtgcctggccttcacctctacctattataatattttcatgttattccattttgtcatgtttgtgggtcatttgatgagggttcacaatatgaaaactgggcattttggccaagatgcatgtaaatgaatacaactccatgtgccctgataactgatttctagatcctgagatgcaagtggcttccagagtgtctgtattttatgaaagttcatatacagtaaaccatgctaattgttactgatacagcttccttgaatatataaagcgatgattaatgggatgttttgtttctgcagaaaaccactgaattgcttctccaaagccaagtgacctgtatgatttgtccttattatattttgtgaaccagtggactaaaacctttataatgggtcatttttttagtattgtcaatattgctcaattaacaaacatgactcatatacacaggtgagatgtagttctccctttgacatttgctctacatctgtcccttagatgatgatatggaagaaaagcactctttggcctgttgtgactgggacagttgacagcacccaggtgtcctttaatgaaaatgctcttgacaccaatgcatcctagcatcacagcttcaggaagccttctcaagtgtgcatggggagtactatgtctttcatcaataatgaaatcttctgatttggtgagaaataatgccttaaaattacactcaataggattatgctgaggctcagcctacctagatgaaaatgctgaaacagataatagtgacttcttatttcccttcaaggggaattttattttgaacttgaaataacaaaatctttatgggtaacttgtttgcccaactgtatcagtgcacctataaatgaacaaaaaattctcagcctataagctttgcttcagtgacctttaatttctaatagtaaggtatattcaggtctcattctttggctttttctcttattgtgtatttcagtaagacatgctgccaagagatgtgccattctattataaaagatcagtagcttcctttaccgacgtgtatattctatctagaacattgagctatggaagactcccacctaagggaattagttttacaccttcaggtaatctgaacttcaatatgagttttgctttatgatataatccttatgacaaaatctttactttttatctgaacttcatacaatcaatattgaagattttttaaattcactgttacctagtccaatatttaatatacatttggctgtagatacatgactagacaaaaattttttatattattattgtgggggctctaacagtgtttcactgttttgagttactgatgaactttctgtaactgtgagaccatggtaatggaagagaccgtggtaatggggaggagaatgtgaggatcagtatgtactttgcctataaaacttaaatatttagtaatttgatcaccaaattgatactcaaatttcagttcctatcatgtgtaaaccaaaaagtatctgagatttagaagtttatttagaagtggattttgccaaggttaagcacatgctcagaagaaataaacccaaaatcacagaaaccgtctggggtctatgtctttctccaaagatgattttgagggcttcagtgtttaaaggggaaaagtgggctggagggggaaaagggagggtatgataatccgtatgttccaagacaaaaggagcaggtaggggtatagtcaataatgtattcatctcatgctcagtaaatcagcactttacataagataaggtgaacatagagaagctacctgtggagatctttaacctttaatctgtagctatctgcttaagatcaaaaggaaattcttgcatgactcagctttcagcttattttttttttctcttggcgtagtaaattggggtcccaagtttattttcctttcacacatgtgaccccactattttcagaataatgaaagcacatgttagaaatgatgacacttattcctaatatggactttgaaatgactgggttcacaaatttagaatcatggatctcattataggtttttattttcaatgagtgactggcctacttgatggaattctttcaaaaaatgttcactttttactgagattatattaaaataatgttggaatgtgttcagtcatgtttaccatctctatagtatgatatatgataatatcgcagattactcagtgtcaaaaacctggcataccttgtccttatgatgttgatgagtcaatggtctagagccttagtaatatgtctttttgtggtagtacggaccgtatctgtccactaagaaatagcctgtgtaagccatatacacatgaacaatttatgtctgattttgaactatggtcccattcctatgcctgtagataaagactgctgagaagagcaccctctggtgttgtcacagaggcaagtgctaccgcacaggcatgctgcagtgaatttaactgatcctctgtccctgcaaccgttgtttaaggatgctattctggtaagggtttacaagacaacgtaaatatatgtataaagagtatcttcaggagacgtaataatgtaaaaatcatgctcaatagaattaagctgaggctcaaaatagtgccaatccttgcaagaaggtgtgagaagtcattagatttggggggtatgggttattccattttgaacttggtaggaagaaacccttgggggaatcttacatcatttgcctctacctacttctaaaggaacttttaaaattcttttatcttgtctttattcttaatactcatacattattagagagaatatcttggtttattttttcctcatggtgtgcttcagaatgttcatccagcaagaggtgtgtcattacacggattatatatatgagttctgtctttcgtaattaaaaaatttcaagtggaccatttgaatattaaacattggccttcaaaatgattacatttacctgttcatacaaaattagtgagcaatgatctattctttccaatgagtgactgatctaatgaggtcctcattaaaactccttttttttttttttttttttttgcctgaacgtactttgatttaaagatgtgacatttagtaattcattgcaatcaactctttagtgattgcacaaatagacaatccttttctattattttattttttggttgctgtgtatggtgttatgatgtttgtggatcattgaggcactactcacaactgaaagactttggcaattttagggaatggcttgagattcagctataggttacccttgattgaaattgaatacaatacaggtagtctgaaatctcatttccttatcctgagtctcactcaggtgtcattagattcattataaagaaatgcatacactatgtatgatgccagttgttactgatatgaagacgataagaagcttttatttctgcagggaaataatcccttaccaggtcatcaaaagacatgatacctatgtgcttggcccttactgtacacggggaatcagtggtctaccacagcttaagtaacgggtcatatttggagtatcacacatctcagtcttgtagaaattaggaacagcaattaggagtcatgcacatataagagatgtaatcccaccctttgactatagcctactcttgtcttttacagaaaagactgtggaggaagaaaaccctttaccctgttgttcagggagaaactgacaccactcaactgcctggcactgaaaatgtggcatccagtccactttaccatcagtgtttaaggaaaccatctctggtaagcatatttgatccaagtgtgcatatgcacatgagtgccatgggctgggtcaatgatgagatgttaccttgaagagaaatgatgacgtaaaaattaagttcagttggattacgctgaggcccagcctaggtaacaattgtgagacaagaagtttggatttcttagtttccttccattggggactttattttgggattctggcaatggaatcttattgcgaaacttgttttgcacgcttctatctgtgtgcttctaagtaaactataaattctgattctttaagtgctatttaagtttcctacaattcctaattttcttggatatttggcactaagacccttgctctttttctctcattggatgatttagtaagtcctactggcactattctattgagtggaggtgagaggctgcctttgctgactgaaaaatttcaaatagataattgaactagtgaagactgagctctataataattagatttattcattcagacaacatgaatatcacgatagggttttcttctcaatgattgactgacacatgtgatgcaatcctcatgagaaaatccttacttttgccctacgattgattgttttcagggttgagaaatatgatacattggaattttgctcaatgcgctacagttatcgtggtctaaatatacagacaaaattttctgtaatgttagtataatattttaacagtgctaggatatgttttgatcattaatgaatctttatgacttaagggtccttgcaattgggataaaaatgtgagtttcaataatatgtgtttgcccatgaaacttgaaattagataaattgatgagcaatctggtgcctgacttttctttctcaagtacctttggcttcgttttcattatgatgaaagtgtgtgctgtgaataatgccaatggtaaataagacctttatggacacttatatgaatgacagtcagggccgttccttcaggccacatgattatcgttatgcattcttcttctcaatgagtgactagcatacttgccaggatctacaagagggaaactttattttttactaaaattgcatcgatataatgttgacaagttttgtgattattggtatcatctctaagatgtgatgctcatttggtctaaatatagaagttaacatattaacttctaatttatatatgtcaggttgctatgtttttacaatgtttgtggtttattgatgatgactcacaacataaagactatggcattatggctacatgttctaattctgatatatacatatcccatcattcattaaattaaatacaattatgagtagtatgatgtctgttttctaaaatctgagtttcacctggctccagtatgatcattatatgatggagtgcaagcaacatgttaatgccaattgttattgatatggcttccttgaatatgtaaacaagactgatcaattgaaggtcttatttctgcattaaactacctgagatattctccaaattcaagagacctgtatagttagtctttattctgtttgatgaataaatggcctatagcctatctaatggatcagtttttccagtactaatcatatctcttcattaagaaatagcatgcataagccatacatacaggaggtaatatttgtcatcttgatctactgtcttatcctcctccccttagataaggatgactgaggaagagtactctttggcttgttgacaccagcacagctgacacacccagatatctgtttggtctcctgtgaactttcaaccaggatttaaggatgccactctggtaggtattttcagacaaagtgaatatgtgattgtagagttccatggcttgtttcaacaataagaccttatgttgtcttgaggacatgagatgacatgaaaactagactggctggtccttatcttttctggggtattctagtttgagcttaagataaagaaatatatttgggatatagtttctctcacctgtttctattagcttctagaagaccacttatcaattctttcctcctgatttagtggaaaacattttggcagttcctcaaaaagttaaagataaaattaccatgtaacccaacaattctgctcctaagtacacactcaaaagaattgaatacaaatgttcaaatgaatacatacacatgaatgttcatagcagcactattcactggctggagttccagaccagcctggccaacgtggcaagaccctgtctctactaaaaatagaaaaattagctgggcatggttgctcacgcttgtagtctcagctactcaggaggctgaggcacaagaatcacttgaacccaggaggcagaggctgcagtgagctgagatcacaccattgcactccagcatgggtgacaagtgagattctgtctcaaaaaaaaaaaagtgaaggtatgatgacaatgtcacacaaaatagtgaataccaataaaaagatagaaattattaaaaagaaccaaatgaaaattctggagttgaaaagtacaataactaaaatttaaaaatttattagaaaggctcaatagtagatttgaactgggagaagaaacaagaagtaaacttgaagatagaacaatagagattatgttcaaaagaacagaaagcataaagaataaagaaacaaagagagtctcagagaatgtggaacatcattaagcataccagcatacacatatgggagtaccagacaggcaggggagatacaaaggatcagaaaaaaatatttgaaggaataatggctgaaacctcccatatttgtggaaaacaataactgacatatccaggaagctcaatgaattccaatgaataaatgcaaagattgacaaatggaaacatcacagtaagatatctgaaagtcaaaaacaagaagaaagtcttgaaagcagtgtgagaaaaatgatttgttacttacaagggaaccccaggaagattaacagctgacttcagcagaagcaatggaggccagaagcaaaggcataacatattaaaaatgctcaaagaaaaaagaacctgtcacctaagaattctgtacctggcaaagctgtctttcaaaaatgaaggcaaaataaagacttcctcaattaaaaaaaaaaaagttggagaatctactgctctcaaaacccccttaaaagagttctctaaatacttaaagaagttattcaagctgaaagcaagtgagcctaggtagttattcaaatcaacaactacaaagcaaatgcttgtaaaggtaattatataaatataaaagacagtagaaatgtaatttttctctgaagtgattttaaaataaattctataaaataatatgtatataatgtattttggggtctataacatataaaagtgtaatatatttgccaaagaagataggtggatgcaaagcaatacaagactaaggaaatgactacagatggtagattaatatttattataatgtctttcttggcttatagcatcaataaatgtaatatgtataataataccacaaaagatggcaaaaagggaatagagctatataggtgtaacatttctgtataagactgaaattaagctagtgtaaattagaaacttatttgggtgagttaagatatatgcagtaaaccctagagcaaccactgaaaaaattcaaaacatatagtgaaaaaaattattaaggaagtttaaatgctacattataaaataattacttaatgaaaaagaagtaaagaggaatagaggaacaaaaacacatgagacacagaggagaagaagaatgacataataaactcaactaaataataaaattacatgtgaatacagtaaatatgtaaattaaaaggcagagattcccaggctggataaaatctccaggtttaatatccctttgccccaaataaactccagctttttttcctatgatgtatttgatcattgtgctggtttacaaaagatttctaacctttctaaaatctttaaaatcagcggcgaagtgttctatctcatttcacccatatatatcagagactcaaatcctgaaaaataccaagttgacctgcccattcttgagttctgctgaatggtgtgttcccagatcactatggatattgctgtttacttgaccaattacttttagtcaacaagatttgaacaatgcttttgattcacacagcgtgagacctagacttccctcatattgaaataggagcattagcatcctggattcctgcaccggcttttgaaccttatgtttcctgcaccccaagaagccatgttatctggacattgtcctctctgtgatgggaaagaagagttttttcaacaaatgttgctaggacaactggatatctagatacaaaagatactgcatttatgttaccagttttctgtgtcagtccattttgctctgatgtaacagaatactgcagactgggtatttgtaatgagtggaaacttattggctcacatttctggaggctggaaagatcaaggggctggcatatgataagggccttctcactctgtcatcctatggtagaagggcaaagagagggtatggatgggacaaatatcttcttttataggaacccacccctgaaataacagcattaatccattgatgagggcagagctctcacagcctaatcaccttttttttttttttttgagacggagtctcgctctttcgcccaggcgagagtgcagtggtgctatctcggctcactgcaggctccgcctcccgggttcacgccattctcctgcctcagcctcccgagtagctgggactataggcgcccgccacggcggccggctaattttttgtatttttagtagagacggggtttcaccgtgttagccaggatggtctcattctcctgacctcgcgatccgcccgccttggcctcccaaagccctgggatcacaggcgtgagccaccgcgcccggccgcctaatcaccttttaaatgttgctttattaaacactgttgcattgagggttacgtttccaagacaggcttttgaagtgaaatgaaaaatttgaccattcccaattatagtttgaaatttcaatgctcctttcttagtatgtgattgaacatggataagataatcagtaacggtggatgtaagaacactattaaccaacttgactccactgtcatatgtagaacacaacacccaacaatagcagaatgcacattatattcaagtgctcataaagcattattttgtatatatgtattttctcccttttttgataaagttagctagtagagtgcctatgtagttaatattttttaaaaaccacaggcttctcaattattaattacatctatggtttttaaaatattatcttcattaatttctgctttgatccttattcctttctttcttgtactttcttttatttttgttcttttttagtgttttaagatgaaaattgaattgtttcattcatctttttcattttttaaaataaaaacatttagtgcaatgaattttcctctagaactgcctttaaatgcatattacagattctcatatgttgtatattttaaaataatatgtaaatatatatttgcatagaaaaacatatttacatacaaaatatgtatttacatatttaaacatatgtattttctgtttatatttttccttttactcaggagttaataggatatttttaaaatttcttggtgaaagcgcctttatcttattgttagtaaagtctatgtttttgcattgtgatcagatagtgcagtttttaatatttcttgagttactaatttttctttccaacctaatatataatcagttttttgtgactatgccatgggcacttaagaacaacacagatcttctattatctgtcaagtttaatatgtagccataaaatctaccttatttttatgttgctatttttgcccacttgatctgtctttttctgataatggtgtattatagttttctattatgggatcatctatgtcttgtctccttacatctcatacatctcatgcagttttttattcataaaggtggttattatgttatttggtatataagtctccataagggtcaaatcttcatgtgtattatatcttttagcataaaaaaagtgtccttctttgccttgattaacatggtgggacttgaatacattgtgtgatataagaattactacgcttgcatgcgattggcatgaaaaaaaaaaagattactcctatctctttttgttttcatgtgcctgatatactttcgcccatccctttattttcagtcttttagaatccatttgttttagattcatctctcatagaaaacatattatgttttattttgtgagcccactgaaaatatttttcttctagtaggtgtgtggagtccactcacgtgtgtgtgtgtgtgtgtgtgtgtgtgtgtgtagctatgactgatatttattgtgtttgtattttctttatatttgctacgctcttttgtcacggtgtagtctttgcttgcctatttattcatacttaggagagtttttgtttttgttggagtgtttacttttgtacctctcttaattctgttagttctgtgttttcctagttaatcttttacttctgatttatcagtttgggggatgttcttcagcactcccctattctcatgcaaagtgctttcggttttcctctttttttttttttcctcctcctgtgtttagttgtcttatttctactttgtcacaatattagtgacatttgtatgctagtcttctaccctggatagggaatatacacctgtcagatggaaggaatatcatgttgtatgctgctgtcaaatagatcctaacatactttaataatcttttaaatgatataatccaagttcatagttaactcctgactttttatttctatcatattcagtagatatatcagcattgacagccatcccactgcaatatcacttcacattttgcttagaccaaagggttctgagaagcttctggagctgttgtgaaagccagtttcattaaagtcaagtcagacatccacctgtgctgttttctgctataagctgaatgcaggggatacaatgttaggagcatcagtgtggtatgaggaatgtttacttattggtagtagacttgtctggatcaaggataagtacaagtatctgagatgctgaggtgtggctgaatgaatggccatctgttctattgcaacaggataaataacacattcggagcaggcctaactggtgaactcctcaattatctcacaatagcactatcacgtgtctttcatttttcacagcacagtgtattttcataaaatctttattggtagaccacaactttagcatttcccattcaagatacaactactgtgtcacttggatagcttggtagagaggaaattggctattttcagagtaaagaattcaaggaggaaacagattataaatgaaatgacaaaggtgatgagatcaagcaatgctgacgtttgtagcaaggagtagagggctgagatgcctgtatgataagaaattataatggaaccaatcttgtgctttattttttattaatttggagcattctctgatctgatttattttctatgtgatattttgctgcaggttaaaagctgaaacaacttcaaggaaacttcagggaaaagaggtgagcagccactttggtacttttgaaattctttgttctgtgggcaatgatgtcagaatgtcaaagactgtgagttcattatttcagaggcttaaaggagattattcttttggtagatatatttccccatgggtgtccctaccttgttcaaggattccttattattgtttcttctctttgtttaaatctctttttgagatgacctaaacaactgtggagaatcattgatatatttccttttttcactgttcatgttgggtgaaaataatcttgtagtgaaattcacatgttctaaatattgtttttttacatctttatctggcacattcataacatagatgtttctatacatattagtactgtaatcataccatatattattctgttaccccacttactccttaaacttttagttaattaaagagtttttataaagtcccccaatagattttttttttttgagacatagtctcactctgttgcccaggctggagtgcagtggcgtgattttggctcactgcaacctccccatcctgggttcaagcaattctcctgcctcagcctgccaagtagctgggattacaggtgcctgccaccacgcccgactaatttttgtattttcagtagtgacagggtttcaccatcttggccaggctggtcttgaactcctgacctcgtgatccacccgccttggcctctcagagtgctaggattacaggcttgagccactgcacccggccagattttaatctaattttattagaacaattcagtcatatgttttttcatgctatgtatatgagagttccattattcagatactaaacaaatgtctactgtacatttactgttctcactgatgatgcattagataaccatgcacaaaataagcctggctgtggaaacgcttatttgttgggagggtgcttgtttggatcgatgatgagaataattgtctgaggatgctgagggactcattccagatgtcaatctgaggtccagatgtgcggccctccaataggacaaataagactctcagagcctggctctatttggggatccctcagtgacaacatagtacccctgtgagcgtgccttttctatctcttcgaagagggcagtggcatcctgtcttatgagtcagtgtgcactttagtgtgcctagtgacccaagacttgctttaattgtagatagatacttacatataggaaatatttcttaagtaacaaatgaaaaactttagaagattgaattaagggtcaagcaactgtgatatgtctgaaaatctcattagtgttgtgctgaaagaaggaaatatggcatgcctctattaaataatgacagtggaaccaagtttattgctttgttatttttactgtggagtattttctaagattatttttgctttttttttctttcatgttttgctgagatagaaggcctggaatctgatcctccacttcagagaacaggggtgagtagctaagccattatcttttgaaattcatatgtcatgtgctctttgctaggtctttaggtcgttttgtacatcttttcagaagcttattggaggacattttcatgatatgtccttttcctcattgagaccctcaccatgtcacctacactattgaatccttatcatttctcttttaattttaactctcttttgcttttatggaaaaatgtagaatttaagagaatttttggcaatttcatattggatcaaaatgtattgtagtgaaatccaggtgtgccaaaatattaacagattttccccatctgtttaattattggggtttcagaatagagactccatggttcataatatctttgtggtcatactacattatatttctgcttctaatttaattattaaatattgacttgaattagtcttttcctcattgttgcaacaaggtaagttatataggaaattttcttctcttgatggcatgtctgagataatcatagatataagacacctggctggtttctagaatgcatgtaatttttatttcttgatctgtgtgttgagtacttgctgtgattgcatcatgcaaatacattgagctttacaattttagtgtatgcacttttctacatgtatattattcttcgatagaaagtaaaaaaaacttatcgaactagtcaaaatattggttaatacataaaaaaagtctcaagtagattgtgtattacatggtgcttgttgattgatgccctcataatagatcaagtgggttctctctttagcacagggctttttagcaaatcatgtcatgagtagttactcaagtatttttattttaacacatttatattttttctatgtatattcttaaattctcttatacttttttctctgttataaaaacatgctgaacaatctcaagtcttaaggattgcagtattgtccccacatattcatgtattttggtactcaattctttatactttctttgacagatcacttgaactggcacatgtctcttgttttgcagagagggaattaatgtgataccttcatgcttttctattctatgtgctacataattgaatatacaagcaaatatagttgttaagatttagtgtgattatttctacaccacatgcaaagaagtttctcatagatcttaatagaggcccacatgcattgtacagtttagaatttggggaaatattgatgaagttgggtaaagtataaagccaaaagtcagaacagtgaactccttgcttaaggatttccttggagattacttagtcaatacacaactgataaatttaagtgcttttcaccttttgagttctcgacatactaaagctaaaatgtgtttcaacttttaatcctgcttccctgattttcccttttttagtctgagatcaaagagtttcagccataaattactgccaagagtaatcacttcattttaagaaagcttaacaatatagaagaatataaaattatttatgacagatgtatttttaaccttttccccatgctttccagaggaaatatgtttaatcatctgccctatattagggaaaaactttctatgctaatacaagtatctatcaatccatttatctttctatataagatgtattgatcataaccaattaactttactgtaaatgagctttagatttgacattttggtagtaatatatgttgtacaatctcctgaggtcctataggtcttgaggtctctatgtcaaaaactatagatgtgccagtgtcctcagtgaatgtgaaggacaccacattttccttagccatttcttgttttcagaataatggttatcaacattttgctactgcaagataccatacatttataatcggaatatgccagtttttatgcactcatgcctctgtttctgtagagcattcccagaatgagtaatgcttgaaaattaggtccatgtgatttctttaatgagttatagtcaaatcatgaaatattcaggttaccattatttcagtaatgtattagaatgtcaaggtaaagttatctacattgtatatatacacacaacatagatataatttatacaacatctatatttatacaacagatatatatttatgtatatatttatacaacataaaatatattttattatttaaacataaaatatattttattatttaatatagattcttaagtgataaatatgtttaatattattaaaataggttaaaataggttatagttagtacagtgaaaattggcagcccttttacaaaacatatgccataactatagcatttatcactgacagtcataccaggatagtcttttatttccaatcacttaaatattcctaattgcaaaagaaatttgaagactaaaattcagaagttttgaaagagccattgcctgggtaaactatacaggtttcagttttatttataataattatgaggccaggcgcagtggctcacacctgtaatcccaacactttgggaggccgaggcgggtggatcacgaggtcaggagatcgagaccatcctggctaacacggtgaaaccccatctctactaaaaatacaaaaaattagccgggcgtggtggcgggcgcctgtagtcccagctactcgggaggctgaggcaggagaatggcgtgaacctggtaggcggagcttgcagtgagccgagatcgcgccactgccctccagcctgggagacagtgcgagactccgtctcaaaaaaaaaaattatgtatatatttataaattaatacttaataaattaataacttgtgataggcaatgcaaagatgacagtaaaaggacaaaattgattagattgataaagtcctgttaacatgaagaaattgaccaggataccatccacactataaagttagagaaatttatcaggacaattccctaaaatactcttctcaattttaacattgtaacaggaatttttaaaattttggtattatgtgtgtttccttccagataatttgaacagattcatatttggtatttttaaaagccatatctttgtccttagtgctggcaatgtattcttgagaatgaacaaataagagatacgtaaaagcataagagaaggtatcaggttgaagtagtcaatcagttatacagaacacaaagaattttatcttgtataatgtttatatagctttatagaagtgtgctgaaagggctataaaacatggacattattatctcattgaaaggtccaatacgtactgaaatacatgcttttattttgaaccaaccaccctataaacgttgtatggcttatttagatgagagcccaggttgtgtgtgtctgtgtgtgtgtgtgtgtgtgtgtgtgtgtgtgtgtgtgtgtgtgtacctgacagggaagcaagaacatcgagttgccaatgcactctgtctatggttagaatcatgctgaaaacatggctcccccagttctggaatgagcccacagatcaagcattccccaaagacatagcaggctcaaatccctgtgtacacaatattttatgattatcttatgtcagtactttcaaagtatacagtttgtgtgaagacaaatccaatgtcatttttcttggctagcctatatgtgtggtaaatccattatttacttacttgcttcctgaaaattacaattagattaacaaactgcagcaaagtgggcatgatgagatagagattgaagtgtaagcttatgttaatgatgcccttggtttggataaacacatctaagagaaaaatggaaaaacacacatggcagggaagccttgatagagccaaaatataggattgtatgtagtaatgcaatccatagatgagcatttggcagtaatattatttttcagatatggataaaaattgcttaggagagtaaagagagacaaagttgaaagcaggtttatagtaggtgttgttttagtgttgatccctttttgctccaataatcaaagtgataaatattgaaaattgattcatgcagcattacttactccattctaatttttatatatgtcaaaagtgccatctcccaaactgtgctatccccttcaggagaagagactctgctgaagtttataaggttgacatattgccagcttcaataatgtaaagatgaagtgtatactgaattcttaatgcaaataacaactctattggaaagtaacccagttatagaagtgctaatttgtcaggagctgccttaccaagatcatgatgagtacagttatctcaggattctgaaagattgttttccgatttcaactagtctagctgaatgttccttgatagaaagagaggacttttagaattggttcaatatgatgacctcctgaattatctcacatagcccgtttgtacatgcctttcttttctctcagaaaatggcactatcataatagctttcttacacagacttcaccttagggttttacattaagggaggggtctggtgtttcatttattttgaagtatttgttgttgattgtgtacagtgcttgagtaaaaaattgaatatagaaacatctagaatatttttttaaaggatcagtgtttataaagtgaattattagtgtcaataatgttgggaaagttttaagagaatataggaaacttgaacattacacaactacaatgggaccaaattgtggggtctcattatagttaatatttatgtatttttttccaattgatttgtgtgctttttttctgcatgtttttggcagatagaatggctataacaagtaacagcatgtcaggtaataaaaataagcagagccctattcctttaaaaatcttcactgatgggagggccataaaataagtcttaatacatttaaagaattaaattcatgtaaaccatgttaatttaattccacaatgatattgaattagaaataagaggaatatctcttgaacatctcctaaatgtttggaaatttaaattagcatttctgacctatttattggttaaaaaagatacaaagaaaggaaaattgaaaagtcttttgaactgaataaaaataaaaatatagaatctaaaactttatgggatactgacaaaacaggatatagggaataatttatagcactgaaatgcctatattagaaaagaaaaaaggttttaaatcagtaaatttgtattttaccttaagaaacttagaaaagaacaaattaacccagacttaagtaaaataaaggcactaataaagataagagcagaaatcaatgaaatataaaacaacaaaacacagagaaaaattgagaaaatttaaaaatagcctagtgagaagatattgataaacttgtaaccagaccaatttaagaaaaaaagtcaaaacacaaataccaatatttgaaaatgtaggagggcaaatcattacagattctatgaatactaaaatgataataaggaaaaattatttaaaaggggcatgtcagccaggcatggtggcttacccctgtaatcccagcactttggcaggccgaggtgggaggattgctagagctcaggcattcgagaccagcctgggcaacatgttgaaaccttgtctacacaaaaagtacaaaaattagctgggtgtggtgttgcacacttgtagtcccagtcacttgggaggctgaggcgagaggatcacttgagcccaggaggttgaggctgcagtgagccatgtttgtaccactgccctccagcctgggtgacaaagtaagaccctatgtaaaaaaaaaaaaatgtatgccaacatttttcaataacttaaatgaaatggaaaaattccttgaaagacacgaactacaaaaactcagtgaacaagtaaataacctgaatagccctgtatcaagtaaattgaatttgtagttaaaagccttccaacagagaaaacttcaggtacctatagcttcatatgaaatgaaaaaaaaaataccaatcctctacaagattccagaacatttaaaagaagggaatatttcccaacttattccatttggacagcaatacccaggtaagaaaaagagacacagaaatttaaaaagaagaatatacattattccttaggaacataaatgcaaagaaatctaatcaaaattttggcaaatgaaatgtagaaatactttatgaccaagtgagagttacccaaagaatttaaggttggttttatatgtaaagatcaaccaatataggaaaatcacttctggaaagtcagagtaagaaactccaaaaatctactcctccataaaaccaataacagccttgatagaaatagttgaaattaattttccaaaactttggaaattaaccaaaggcttacaaaattccagagaacattaattcaagaaaaatggctgaatcagtaagaacagccagctttgtggcattttaatatgaccccttcccatgcttttctccctagtgctgagatagtcttaaaaattagcaggatagcaaccactggagaagaaaggtttggaaatttcccaaaaagttccatccccatagaattatcactatttgacctctaaagcccaatctataggatttatattcatttggactgactcagagctcactcagtaaggaaatctcaatttcaaggtattggtcaaaaagaatccatggcaattgttgactatcacaactgcctgaagtcttggtaacagttgggataaacaagaagctgatcaaaaactgaaaactaaaatcttgggaatgagatatctacaggatgcttcaaaaagctttgatacattcctgtttatctagaaagctacatgcaggctgggtgcagtggctcacacctgtaatcccagcactttgggaggccgaggcgtgcggatcatgaggtcaggagtttgaggccagcctgaccaacatggtctctactaaaaacacaaaaattagccaggcgtggtggcgtgcatctgtaatcctagctactcaggaggctgagacaggagaatcgcttgaacccgggaggcggaggttgcagtgagccaagattgtgccactgcactccagcctgggcgacagagcaaggctctgtctcaaaaaaaaaaaaaaaaaaagccacatgcatgtaattgtttacctctggctttccttttatgctctgggcaagctaaggaagagttgtgaactacctaagtgctgaatgggaaccataacacacacacacacacacacacacacacacacagcaccttagtaaagggtgagaggcatgttagttagaagcattaaaggaaatctctttctagtcattatctgtgcactaacctaactgagcagagacttcagtatccacatactacagggcatataaactttacagaattagtccaggaaaatcatatctaaaaaaaaaaaaaagcagtaacaaaaataaactctgggaaaggggagaatatgatttaaagagttgccacattatacataatatgtctagtgttcaacaaaaaattacgagacatgcaaagaaatagaaaaatatggcacaaagaggataagatgaagtcagtgaaactatcctcgaggaagaccagatgttggtcttactagacacagacattgaaccagctattaaaaatacgtacacagaactaagaaaaacatgtcaaaagggttaaagaaaggtataaaaatagtgtcttaccaaatatagactaccaataaagagatagaaattataagaaaagacaacatgaaaaaatataaagcaaaaaaattagacaattgaaacaagagggcctctattcgcagatttgagcaggcagaagaaagaatcagtgaacttgaagatatgtcaactgagattatccagtctgagcaacaaaggtgggaaaaaatgaagaaaactgagcaacaaagaactgtagaacagcatctctcataccaatggatacataaactggagccctagaaggatgaaaaaaggagaaggaaagaaaacttcccaaattttaagaaaaacattaatttatatacccgagatgaccaataaaatccaattaagataatctcaaagagaccaacacctatacacatcatagtcagcgtgtcaaaagacaaacataaggagagaattcttgaagatagtaagaaaaaaattattcataacatacacaccatcctcaataagtctgacaattgacttctcactgtaaaccatgcaggctaaaaaggcaatgtacataaccaaagtgatgaaataaaaaccttcaaccaatcattctagatccaacaaaactattgttcaaaaagaagaaatgaagacattcctaaacaaaatctcagagaaatgttctctataagacttgtcctaatagaaatgctaaaggaactccttcggtctgaaatagaaaggcactggagagtaaatcaaatccacgagaagaaataaagagaaccagtataagtaactacatgtgtaagtttaaaacaaagtataaatttattttgtttgtaacatttgtcttttcctatttgatttaaaatataatctcaattataaacttgtgttgatggtattatataaagatgtaattttgggttatagcaccaaaatggcagaataggaattttctgtaggtgtttcccacataagtatcaattttgacaaccatccatgggcaagagtaccttgtgggagttcaggagttgacagtaaaacttcagcacaccagaggagtaaagaaatctaagaatagattcattggaaagggtataaacagtttcactttacctgcatcaccaacccccaaaagtggcacagctcagtaacaagagcccattatttcttccacagaggaaaaggagagtataataagtaagtgtccagtttctcaagacatacaggcccctgcccaagagatccactttattttcatctcacccagaatattgaggtgatcagcaaggtggagtggttgggagagggtaaaagcaggaaagagagatggggactcaaacagcagcccatacttggaactgccatagatcctaccagttacttcatggactccatcaggaacccacctataagccacaggggatgcatccctcccatcttgccaacaaaaccccgaatgctccaaatgcctcacccactctttggctggctcccaagtgcgctcctgtgaaaagcgagtgagtatctctgcagatggcttgcaagcacatgttgacagctggctccactctgtagaactggaaaaaagctcacatacatgagaatttcaggacactaccctaaaaaaaaaaatgagacttcagcacctggcctggctttatgcaacctagagaaggtgatatgatttggctctgtgtccccacgtaaatctcatgtcaaattgtaatccccacgtgttggacaagggacttggtgggaggtgattgaatcatgcgggtggacttccctcttgctgttcttgtgatagagttgttatgagatccagttatttgaaagtatgtagcatgtcccccttcactctcttgcactcctgctccaccttggtaagacttgcttgctacccctttgccttctgccatgattgtaagtttcctgaggcctcccagctatgcttcctgtatggcctgcagaactgaactgtgagccaattaaacctcttttcttcataaattatccagtcttaggtagttctttatagcagtgtgagaatggactaatgcagaaggcatacaacctttagaatttgcccccttgagggaacaagatgtgtgaagcaggttcatccatagaaaatgtctgagagaacctcaaaatccctaacctgactaactgatgaaagtgtttctctcctaaggccagtcagtaaagaccagagggggtgactgtttctttaaatgcaaaggcagcagcacaataattcaagaaacatgaaaaatcaagaaaacatgacaccaccagaagaacacaatcattttccaataaccaactccccaaaaatggagatttacaaattggtttataatgaattcagaacaattatgttaaggaagctcagcaaactaaaaggaacaccaatagactactctgtgaagtcaggcaaacaattcatgaacaaaactagaaattcaaaaaagagaaaaattatcttaaaagaaaacccagaagttatggagctaaagaatacaatgcatgaaatgaaggagcgtatcaacagcaaagttgatcaagcataagaaaaaaaaaatctgtgaaactgaagactggctatttgaaattattcatcagaggattaaaaaaaaaagaatgaaaagaaataaagaaagcctacaggatgtataaaacaccatcaagagaactaatataaggattattggagtcataaaggagaagagagaaaagggtagaaaacttatttaagaaataatggctgaaaactctccaaatctaggaaaagatatgagcatccaggtatatgaagctcaaagatccccgtacaggatacattccaaaaagacttcaccaaaacacatgataatcaaactgtcaaaagcaaaatcaagacgatgaataaaccaccaatcactaagagggagacaggattcttatgttgtcattattatttacatataatttcagtaaatgttattggaaaatttataatgttttaaaaaaagaaatttgaaagcaccgaaagaaaagagactcatcacatacagggaacccttttaaggcattcaagagatttctcagtagaaaccttacaaaataggagagagtgggatgaactatacaagtgctgcaaggaaaaaaatgccaaccaacgctttacctggcaaatctgttcctcagaaatgaaggagagagaagaactttcctagacaaacaaaagctgaggcagttcatcaccactagacctgccttacaagacatactaaggggagttcttcaagctgaaatgatatggcaatagttagtaatatgaaatgataaacctcactggtaaaggaaagtacatagtcaaatttagaacactttgatactataatgatggtgtataaataattttactgtgctatgaaggttaaaagacaaaagtattaaaaaaaacccatagctgcaatagcttgtcaatgcatactacagtataaaaagatgtaaattagaacattaaaaacatagcatgcaagggtagggaagtaaaagtgtagttttcatatgtaatcaaatttaatttgttatcagcttaaaataaattgttatacctatgttttatgtaagtgtcatggtaactataaaggaaaaacctctagtagatacacaaaagaaaaagagaaaggaatcaaaacataacactacagaaaattatcaaattacaaaggaagacagcaagggaggaacaaagtaaaaagagcaagaaaaaatttaacataatgaaaacagtaagtccttacgtgtcaataattactttaaatgtaaatggattaaattatccaaacaaaaaaacagactggacaaatggattttagaaacaacaacaacaacaaacaccgcacacacacacacacacacacaaaccacccagccccaactatgtgctgcctacaagagatttacttccactttaaggacacatacaggctgaaattaaaagaacagaaaaagatattgcatgcagatagaaaccagaagagaggagaggcatctatacttacagcatacagaaaagattttaagttaaaaactatatcaaaaggctaagaaggtcaaaatggtgaagcagttaattgttcaagaagacataaaaattgtaaatatttatacacccaatattgaagcacctaaatatataaggcaaatattaatacatataaaaggagaaatatacagcaatacagtaatagtagtgaacttcagtgcctccctttcaaaaatggataatccagacataaaatcaataaggaaacatttaacttaaacttcactttagaccaaatggatctaacagacattatactgaacatttcatccaacagtggtagaattcacattcttctcaagcacacatggaacattctccaggatagattatatgttagctcacaaaataatattacaaaatttaataaagctgaaatatcaattattttgcaccacaatagtataacactagaaatcaataacaagatggaaactggaaatttacaaatatatagcattaacatattcctgaacaaccaatgggtcaaagaaaaaaatcaaaataattttgtgacagcaaagtagaaacacaacataccaaaacatacaggacacagcaaaagcagttctatgaggtaagcttatattgataaacacatttaaaaaaagattttaaataaacaacattacacctcaaggaactacaaggaagaaaaaaaaacaagccccatgttatcaaagggaaggaactaacaaagatcagacagaaataaatgaaacatagactagaaaaacaatagagactattaataaaacttagagttagttttttaaaaaataaaatcaacaaacctttagctagactaaaaaaagagaagactcaaataaaataaaaaatgaaagaggagacattacaactgataccacagacatacaaattaagagaaaactatatgccaacatattagttaacttgcaatgggtaaatccctagaaacatacaacctacaaaaactgaatcatgaagaaatggaagatctgaacagatcaataatgaataagggaattgaatcaatattcaaaaatctcacaaaaagaaaagctcaggatcagatggcttcactggtgaagactgccaaccatttaaaaaaattaataccactctttattaagctcttccaaaaaaattgaagaggagaaaacactttcaaattcattataagaggccagttttaccttgatatcaaagatttaaaaagaacactttgagaaaggaaaattacaggccaaaacccttgataaatatagatgcaaaaatgctcagcaaaatactagcaaacctaattcagcaacacattataatggcatacatcatgaccaagtgagattcatgcctcggatgcaggatagttcaatataatcaaatcaacaaatgttacactactttaacagaatgaaggataaaaatcatatgatcatctcgatggttgaactagtttacagtcccaccaacagtgtaaaaatgttcctatttctccacatcctctgcagcacctgttgtttcctaactttttacagatcaccattctaactggtgtgagatggtatcttattgtggttttgatttgcatttctctgatggccagtgatggtgagcatttttcaagtgtctgttggctgcataaatgtcttcttttgagacgtgtctgttcatatccttcacctactttttgatggggttgtttgtttttttcttgtaaatttgtttgagttctttgtagattctggatattagccctttgtcagatgagtagattgcaaaaattttctcccattctgtaggttgtctgttcactctgatggtagtttcttttgctgtgcagaagctctttagtttaattagaccccatttgtcaattttgtcttttgttgccattgcttttggtgttttagacatgaagacagtgtggtgattcctcaaggatctagaactagaaataccatttgacccagccatcctgttactgggtatatacccagaggattataaatcacgctgctataagccataaaaaatgatgagttcatgtcctttgtagggacatggatgaagctggaaaccatcattctcagcaaactatcacaaggacaaaaaaccaaacaccgcatgttctcactcataggtgggaattgaacaatgagaacacatggacccaggaaggggaacatcacacactggggatggttgtggggtggggggaggggagagggatagcattaggagatatacctaatgctaaatgacgagttaatgggtgcagcacaccaacacggcacatgtgcacatatgtaacaaacctgcacgttgtgcacatgtaccctaaaacttaaagtataattaaaaaaaataatgctgctataaagacacgtgcacacgtatgttcattgcggcactattcacaatagcaaagacttggaaccaacccaaatgtccatcaatgatagactggattaagaaaatgtggcacatatacaccatggaatactatgcagccataaaaaagatgagttcatgtcctttgtagggacatggatgaagctggaaaccatcattctcagcaaactatcacaaggacaaaaaaccaaacactgcatgttctcactcataggtgggaattgaacaatgagaacacttggacacaggaaggggaacatcacacactggggcctgtcgtggggtcagggtagggggagggatagcattaggagatatacctaatgtaaatgacgagttaatgggtgcagcacaccaacacagcacatgtgtgcacatgtaccctagaacttaaagtataataaaaaataaatcatatcatcatctcagtagatttagaaaagcatttaacaatattcaacatcctttcagaactaaaaactctcaataaatcaggtatagaaagaatgtgcctcaacactataaaagccacatatgacaaacctggaggtaatatactcaatggtgaaaagtaaaaagctttgactctaagatcagaaccaaaacaaggatgtccattctcaccacttatatttaacatagtagttgaaattctagctagagcaattaggcaagaaaaaaggcacccaagttggaaagaatgaagttaaattgtctctgtagatgacatgatcttatatatagaaaacactaaagactccaccaaaatgctgttttaattagagcttaaaaaaataattcactaaagttgcaggatacaaaatcagtatacaaaaatcagttgcatttctaaacaccaaaaacaagttatccaaaaaattaagaaaacaatcctatttgtgatatcatcaaaaaataaaatactaaagaataccaaagaaactgaaaataaatggaaataaatggaaagatagcccatgttcatggattagatgaattaatactgttaaaatgttcatactacccaaagcaacctacagattaagtgcaattcctactaaaattccaatgacatttttcacagaaatagaaaacacactcctaaagtttgcatggaaccgcaaaagactcaaatagatgaagcaattttgagcaagaacagtaaagctggagacatcacactacctaacttcaaaattttattaatcaaaacagcatgacataaaaacagacagaaaagaccaatggaacagaatagagagcccagaaataaactcacgtttatagagtcaactaatattcaacgaaggtgccaagagtacacaatggggaaagtatagtctctacaataaacagcactgggaagacaatatccaaatgcaaaagaatgaaattacacccttatcttataccatacacacaaatcaaatcaaaattgataaagacttaaatataagacctgaaaccatacaatctttaggcaaaaactcattgacattggtcttggcaatgatttttttgatatgacaccagaagcacaggcaacaaaagcaaacctaaacaagtgggaccctaacaaactaaaaagtttctgcacagcaaaggaaacaatcaatcatcagaattaaaaggcaatttatgaaatgggagaaaatgtttgcaaaccacatatctgataaagggttaatatccaaaaatatataaggaatgcataaaattcaatagaaataaacaaacaaataatccaattttaaaatgggtgaagaacctgaatagacattttttcaaagaagacttacagataggcaacaggcatatgaaaaaatgcttgacatcactaataatcagggaaatgcaaatcaaagctccagtgaaataccacctccaactattaggatggctattatcaaaaactcaaaagaaaacaagctgggggaatgtagagaaaagggaaaagaagatccttatacactgttggtgtgaatttaaactggaatagcccttatggaaaacagcatggaggttcctcaaaaaattaaaaatagaactactatatgatccagcaatttcactattgagtatatatccaaatgaattaaaatcactgtcttgaagaggtatttgcacactcatatttatttcagcattattcacaatagccaagacatggaatcaacctaagtgttcatcagtagatgattagataaagagaacgtggtatatagacacagtggaatctatttagtgttcaaaaagaaggaaatccaacttttaaaatcctttaaaaagttaaactcataaaaacagagaggagaatggcggtttccaggaactggagggtgggagaatggggagatgttggtcaaaaggtacaaactttcagttataaaatgaataagttctagagatctagtgtacaacagcattactatagttaataataatattttttatacttgaaatttgctaagagtaaatatcaatattctcaatacacacaaaacagaactatctgaaggcactgatatgttaattatcttcattatagtaatcatttcacaatgtataatgaatatcaaaacaatagtgtacatcttaaatatatacagttttgatttgttaatcatacatcaatgaagctagaaaaaatgttgtaatttttaaaacaatagtaatataaattaggggtgaaggaattgacctatgttggagaaaagtttttgtaaactatttaaattaattggtatccattcaagctagattatttttaattgttaatttaattgtaatactaaggcaaccactaaaaaagcctttaaaaaaatatagcacttgaggctgggcatggtggccctcaattatatatataatatatataaaatatatattatatatatagtagatgaacaacaatgggatttaaatggtacactagaaaatatctgtttaacaaaaagaaagcaatagtggagaaatataagaacaaaaccatgtaagatttatagaaaatgaatagcaaattggttgacctaaaccctatcttataattatattaaagataaatgaaataaatactacatcaaaaggcagagattatcagaatagagaagaaaaatccaaaccataattcaaccttatgttatctgtatttagaatatttagagtcaagacacaaatagatagagttccatttgggcgtgaaaatatttaccatgcaaaatgtaattaaaatagagctagagcagcaatactaatatctgacaaaatatactttaacaaaaattgttgctaaagacaaaaaagaacattttataataagacacaacaattataaacatatacaccaaacaatagagcccaaaatatacaaagcaaaaactgctagaattgaagaaagatagaaaaatcaatgattacagttggaggtgtcaataccaaactttcagtaatacacagaacaacaagtcaaaagcaaaaaggaaataaaaaactacacattatcatacaacaccttaatacgatatccaacaatagcagaatacacattattctgaagtgcacatggaatattcttcaggatgacacatattaggctgtaaaacatatcttaataatttaaaagaattgaaataatacagcacatattctctgactgcaaaatattaaaccaattacagaagaaaatgtgggaaattcacaatgatatggagatttaaaaatacttcaaagtaaccaatgaatcaaagaacaaatcacaagagaaattagaaaatattttagatgaataaaactgaagaaacaacataccaaaattttgtggttgtagctaaagcagtgcttcaagggaaatgtataacagtatatccctaaattttaaaaaaatctcaatccaataacctaatttttcaccttaagaaatgagagtgaaagagcagacttaacccaaagtaaacagaaggaagaaataataaagattagcatggagataagtagtgaaaataaaaacaatagagaaaattaataaacttgaaagttggttcttctgatatatcagtaaaattgacgtattattagtttgaccgagaaagaacaaaagagagaagattcaagttactagacataaatgaaagtatagatatcaccttacagaaattaaaagaattctaacagaatattgtgaaaaagtgaatgtcaaaaaattaaattatatgagatacacaaatccctctaaaggcacaaactaccacagctggtgtaaaaacatgaatacaccatttacagttaaaaagactgaatagataaaaattttaagaagaaattgagtaagtaatttaattttcaaactataatcccaagaccagatgttttcattggtgaattctaccaaactttaaaaggattaatatctatttttcatacactctttccagaaaatagaaaaggagggaacactctataactcactgtatgaggtccgtattacccttatatcaagaccaaacatcataagaaaagaagactaaagacttatggtttctgctctgatatgtttggaagtcatcactactattgtcacaaggaaaaatctgaacaaactaaagtcaacgatttcttaaactaaccatagaattgaggtaacgggcgaaaactggagatgtaggcaaatacaaaaaaaatcacagtttatcaggagcagaaactgctgaaaccagcaactcgtatgaacatgttaagtggtaattgacaaatttctggagattgaatgtggactggattgagagttaggaactcctaagtgcccagtttttgatgaccccacacacttttgtaaactagacttccaagagccccagcaagtttcttacagtgaagactgcagaaaaatcccctgatgcttcagataggaggaagggaaaagcaactattttgaaataagcccaggggacaagtagttatttctaaacactctcagagcattttctttcacacggcagggggctccctgcaagggaagctactttgcctgagccttgtctgatgtaggagaaaaggaattggatggctcaagctccatctagcctttctgatttatataagggaagcaaaaaataggttaagaaactcttctgaaagtcacaactcagatttattttatatttatttatttatttatattttttgagacggagtctcgctctgttgcccaggctggagtgcagtggcgcgatctcggctcactgcaagctccacctcccgggttcacgccattcttctgcctcagcctcctgagtagctgggactacaggcgcccagctaattttttgtatttttagtagagacggggtttcaccacgttagccaggatggtctcgatctcctgacctcgtgatccacctgcctctgcctcccaaagtgctgggattacaggcgtgagccaccgcacctggcctcacaactcagatttaaccataagattatagaacacttctcctcccaaaacagagatatagatcaatggaacagaacagagccctcagaaataacgccgcatatctacaactatctgatctttgacaaacccgagaaaaacaagcaatggggaaaggattccctatttaataaatggtgctgggaaaactggctagccatatgtaaaaagctgaaactggatcccttccttacaccttacacaaaaattaattcaagatggattaaagacttaaacgttaggcctaaaaccataaaaaccctagaagaaaacctaggcattaccattcaggacataggcatgggcaaggacttcatgtctaaaacaccaaaagcaatggcaacaaaagacaaaattgacaaacgggatctcattaaactaaagagcttctgcacagcaaaagaaactaccatcagagtgaacaggcaacctacaaaattttcacaacctactcatctgacaaagggctaatatccagaatctacaatgaactcagacaaatttacaagaaaaaaacaaacaacctcatcaaaaagtgggcaaaggatataagcagacacttctcaaaagaagacatttatgcagccaacagacacatgaaaaaatgctcatcatcactggccgtcagagaaatgcaaatcaaaaccacaatgagataccatctcacaccagttagaatggcgatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattgctatatatatatatatatacccaaaggactataaatcatgctgctataaagacatatgcacaggtatgtttattgcagcactattcacaatagcaaagacttggaaccaacccaaatgtccaacaatgatagactggattaagaaaatgtggcacatatacaccatggaatactatgcagccataaaaaagatgagttcatgtcttttgtagggacatggatgaaattggaaatcatcattctcagtaaactatcgcaaggacaaaaaaccaaacactgcatgttctcactcatagatgggaattgaacaatgagaacacatggacacaggaaggggaacatcacactctggggactgttgtggggtcgggggaggggggagggatagcattaggagatatacctaatggtaaatgacgagttaatgggtgtagcacaccagcatggcacatgtatacatatgtaacaaacctgcacattgtgcacatgtaccctaaaacttaaagtataataataataaaaaaaggctacctaaaaaaaaaaaaaagaacacttctcctcccaacaccatatcaccacatcaaccaggactccagtgtaatagcagtgaattctaactgaaagaggtgaaagacactgattgtatttaagaaagatcttctaaggaaatccaaaaatagtaggggagatcaaaacaaagatactagaggaaattgaatatgtgacacctatagctacaaaaaaattaaacataacatagccctaaccatataaacataaaacctcacacaaagacctattatctgagattctgttgcctgatacattgcgttttatttcaataaaaaaattagagggtatgttaaaaagcaggaaaagttagtctaaagagacaaattgagcctcagaagtaggctcagatatggcagagatttggcaattatacctagagtttaatataaatgattaatataataagtgttctaacagaaaaaggcaacatgcaagaacggatgggtaatgtgatcagcaagaaggaaactctaagaaagaagtcaaaaggaaatgctaggaataaaaacctacaagaaataaagaatgcctgtgatgggttcctcagtagactggacaaggtcaaagaatcagtggatttgaaaatatgtcaacaaaaactgccccactgaaatacaaaagaaaaatagaattttaaaaacgtaacacaatctccaaaacagtgggacaattacaaaagatgtaatgtgcctaatgcaaatgacagtaggagtataaagggagaaaggaatagaaaatctgaagtaataatggcagagagttttccaaaattaatgctaaaccacagatacagcaagcccagagaacaacaaggaggaaatttagtaaagcgtctgcaaccaagtatgtcatattcagactgacaaaaccaaaggtgaagagaaaatattgaaagaagacaaagaggaaaataaatatcaagaaaatacatacgaaatacatcatacatacataagaaatacatcagaccatacaagcaagaagagaatggagtgaaatgtttaaaatgttgaaaaaaaaactatcaatttgcaattctgtatccagtgagattatctttcaaaagtgaagagggaaatggcagagaagtcatctccaagacctatggtttcccttcacagaaacactgaaaaatatgaacaaaagtggtcagaattaactttctaagaattctataaaatggtaaaatgtttacaccagtaaagcaaatgctgaattgagaaggcaacttaaaaaggtgaagaaaacttcgtattatttttatgtgtccttgccccacgtccttccctaccttagtcttgaagatggcagcccacatttctactgtggggctctggtttctgtttcctggttcaagagggagaataacagaccttacttttagtcattattatttccttctttctgatttccttgggtttattttgctcttctttctactttattgaaatgagaactaagattatgatttgagacatttttctaatgtaagcatttagtgctataaatttccatctcaacactgctttagtcacatcccacaaatttttatatgttgtaatttcactttcatttagttctatttttaaattttttctttttatacttcctctgactcacagattacttagaattgtgttgttcagttttcaaggatattgtagattttcctgtttctctgttgtctaatagttctgttccattttgtacagatagctcacgctgtatgatttcaattttttaaaaaattgtgctttgttttatggcccagatatggtctgtgctgtgaatattccatgttattataaagtatgcctgttatattattatatatatataatatatataattataaagcatgcccgttttgtattgttagcagagtattctagaaatgtcaatgagatcttgttggttgatggtgcttttcagttctatatctttgctaattttttttttttttgcttagtagctatatgagattctgagagaggaaattgaagtctccaaccataattgtggatttgtctatttctcctatcagttctatcagtttgtgcatcacatatttgaggctctgttgtttggtgcatacacaagtggaatcattgtgccctcttggtggcttattttatgattatatagtgcctatctttgtggtatttttatttgctcttaaatctactttgtgttatattcatatacccattcttttttaaaaaaaattgtttgcgtgatacatcttttccattcttttaatctcagcctatctgtgccattgaatttgaagtgagttttcatatagagaacatattattgaatcatcattttaaaaattccttttgccaatcttttttatactgaggtaaaattgacataaaatttatcattttaaagtgtacaatacagtggcatttggtaatacacatgttatgcaacgttaactctacctggctcctaaatgttttcatcatccccaaaaggaaacttcatactcattaagcagttaattcccattccttctctcggccactggcatccgcaaacctacttttctgtctctatgaatttacctattatggatattttgtataaattgaattatacaataagtgacctttatgtttggcttcgttcgcttcgcatactatttttcgatattcaaccatgttgtagtatgtatcagttttatttgaataactcaattctttttgttgtatagctaaaagttgattcctaggtcataatgataattctatgtttagtttattgaatagctgccaaagtttttccacagtggctctgtcattttaaaatcccactagcaatggatgagagttccaatatctccacatccttaccaatattgttattttatatttttataattataattttcctagtgaatacgcaatggtatctcattgtgtttttggtttgcctttccctaatgactaatgatgttgagcatcttacaatgtacttgttaactatttgtgttctttagagaaatgtctattcaagtgccttgtccattttaaaaatcgagttgtcttgttgacttatgagttctttaatacagtaaacgcttatcagatatgatttataagtattttaacccattctgaaggtcaccttttcacttttgtggtagaccattatgcacaaaggttttaattttgataaatccaatttatccgcttttgttgttgtttttgttgttcgtgcttttgcaaaacctagtgtcatgaggttttctcattatctttggagaattttatagtttgggtctatacatgtagattattgatctaatttccattaatttgtgtgtatgctacgaggtaggggtccaaattcaatttttgcattgaattgaaaattcatattttcagtttcaaatttcaactgcatattcagttgttgcagcacaatttgttgaagagatcattctttaccacagggaatgatctgggacccttgtcaaaaatcaattgatcatagatgtatgggattatttcagactttagatcttgttccatgaatatgcctatttttatgccagcactgcagtattttcattactgtagctttatcataaattttgaaatcaggaagtatgtatcctccaagtgtgattttcatttgctagagtgttttgactatttggggtctttgcaattccatatgaatttcagaattggcttttcatttaaaaaaatggtagttgagattttcataggaattatattgaatctacagatcactttgggtagtattgccatcttaacaatattgtattccaatccataaacacggatgtattgccattcatatctttttttcttttctttcggcaacatttagtatatgacacttgtaactccttggttaaatttatacctaagcattttatcctttctgatgctgtttaaatggaattattttattaatttctcttttagatggcttgttgcaggtgtatagaaatagaactgattattgtgcttttattgaattatctgaaactttgctgcatttattaactctagtaggttttttttttctttaaagttgtctatatatcttgctctgtgaatagataattttacttcttgatctccaatatggatgcctttctttctttttcttacctaattgctgtagctagaattttcagtataatgtatgatagaagttgttcacaactatccttgtcttctttctgatcctaggggtatagctttcagtctttcaccattaagcacaatgttagctgtggggttttcttagatgccatttaatatattaaggaagtgctctgctatttctaattggttgagtatttttattataaaatggtgttagattttatgactttatgtactgcataattgagattatcatgtggtcttttcattcgattaatgtggtatattttatgattttcatatgttgatccacctttatattcttggggcaaatcccactgtgtacacgggttttttagggtctcctaattttcttcattctttttcttttctctccctgagactgaataacgttaactgacctatcttcaagtttactattttttcttctgctgttcaaatctgcttgaacctatagagtgaatttttcattttacttattgaacttttcagctccaaaatttctctttggctactttgtataatatctatctctctatagatattctctatttggaaagacatttttctcctggttttctttacttatttgtattttttaaagtctttaagcatatttgagacagttgatttaagtatttgtgtactaagtccattgcctaagcttttgcatagagattttatattaatttcttttttttctgtgaacaggtcttttttttttttttttttttttttttttttttagaaaactggacattttgagtagtataaacgtggctattttagaaataattttcctccctccttaggttttgtttccacttgttgcatgttgctgttgtttgctcattagtgacttttctaaagtattttgaaaagtctgtgttcttgatcatgtgggtccattgaattctgtattctgttaatttcatagtcagctagtgttctgaaagttcccttaagtgcatagagccaataaaagaaaaagaaaagaaacacagaaaaagaaaagaggaaaaaaggagggaaagagatttaaaaaaataatgtcggttgggcatggtggctcatgcctgtaatcccagcacttttgggaggccgaggcaggcaaatcacttaaggttgaccatcctggccaacacggagaaaccttgtctctactgaaaatataaaattagccgggcatggtggcacatgcctgtaatcccagctactcgggaggctgagaggtaggagaatcacttgaactcgggaggtggaggttgcagtgaactgagatcacaccactgcactccagcctgggcaacaagaatgaaactccatctcaaaaaaaaataataataataatgcctttgccgatttgctctgtgtttgggccctcattcaatgcctagtcaggccatttacaactctctcttaactttcactacctgcttgtgtactgactgaaggccacctataggtgaaagcttaacatcatctcagatctttttggaccatgaatcctaccctgggtatgcacatgatcttcttaatttcccagtagatgcaagagttttagtgttttaaaagtccttattccctcatctatcttcttttctgacctttttcagtctgcttattgttcatctgaactgacatcctttgccccaagcggctgtggcaaaaacttttacctttaaatgctttcaccacaagccacttgggaagctgccccagacctgggactgctctgaccctgatgaaacaaagacaagaccttgtacagccaggcagccataagacaagtccatacccaaaccacagttctttcagaataaggtctatattggattctctggccctagtaaccagcatgagtctgggcttgccatcttcatggccacttgtcttagtttgctagggctgccataacaaaatatgagagactgagtggcttaaacaagagaaatttattttttcacaattctgaagaccagaagtccattactctgaaatctctctccttggcttgcagatactgccttcttgccgtgtcctcacacagccttttctctgtgtacacatccctggtgttttttaagcctgtccaaattttctgttcttctgaggacaccaatcagattggattagcgaccacccatatgatcattttaccttaagtacctcttcaaaggtatcagagtagtatatttgctacagttgatgaacctgcatacaacatcatcacttgaggtctgcagtttacattagagttcatcgttagtgttatatattctagggtttgttttgttttgagacagaacagagtcttgctgtgttacccaggctggagcgcagtggtacaatctcattgctacctctgcttcccagattcaagcaattctcatacctcagcctcctaagtagctggaactacaggcgcacaccaccatgcccagctaattttcgtatttttagtggagatggggtttcaccatgttggccaggcaggtcttgaactccttgcctcaagtgatctgcccgcctcagcctcccccagtgttgggataacaggcatgagtcaccatgcctggccttattctatgggttttgaaatgtataatgacatgtatccatcgttgtagtattagatagaatagcttcattaccctaaaagtcttctttgcactgggttgagttttaaaagctctttgattattttatgacagttccttattagatatatcttttgcaagtatttttatcagtctgtggttatcttgtcttttacagagcagtaatttttaattttaataaaatccaatttgtcaattacttatctcatatgactctggtgttacatctaaaatgttaccaccatactcaaggtcacctaggttttctctaggaattttatggttttgcattttacatttggtgtatgacccatttgaagttaatttttgtgaggttgtaaggtctgtgcctagattcattttttttttttttggcatgttacttcagtattcataagaaacattgttctgtaatcttctttcttatagtatcttagtcttgctttagtttttgggcaatgctggcctcactgaataaattcaaagtgttccctcctcttcaattatttggaaaagtttgagaaagactattgttaactgttttctaaatttttggtggaatttaccagtgaaccaactggtcctaggcttttctccagtaggtggttttgattatgctttcaatctctttacaagttacacatctatacagacttttataattcagtcttggtaggttgtgcgtatttaggaatctgaccacttcatctaagttatccaattagttggcatgcaattattcgtagttctctgaataatcatttttatttccacaaaattggtaatatcccagtttccattttttatttcattgaatcttcttttttcttagctaatctagctaaatgtttgccaattttgttgatcttttggaagaaccaacttttgatttattaattttctctactctttttctgttctttatattatttatttccacactaatctttactattttcttccttctgttggcctttaattttttttttttaatttttaaggtgtaaatttaggttgagaaattttttaaatgaaagcatttagagctataaattttccttctggtgttcctttcactacctgccataaattttgatatgttgagtttttgtttgtcttggagtattttctaatttgtcttctaatttcttccttgacctattggttatttaaatgtatttaatttttgcatattgtggatttcccagttttccttctgttattgatttctagttttattccattgtgatcacagaagatattttgtataatcgcagtctattaacatttattaagtcttgtggcctaacagaggatctatgttggagaatgttccaagtgcaattgagaatactattctggtgctattaggtgaagtattctctatatgtctgttaagtccaattcatctatagtgttgacgtttcctgttccttactgattttctgacttattattctatccattattaaaagtggagtggtaaagtctctattattgtagaactctctgtttttcaagtctatcaatatctgtttcatatattttggagctctgtttgctgcatatgtgtttacaattgttatatcttcttggcaaattgaccagtttcatcaacataaaatataattcttattgtcttctaacagtttatttttctttttacataaagcctattttatctgatcttagattccctcacactccaccccagcacgcttttggttacatttacataatatatcttttccatcctttcattttcaacctgtttgtgtctttagatctaaagtgaatgtcttacagacagcataagctatgtcattaaaaaaatccattctgcttatctctgccttttgactggggagtttaatccatttgcatttaaagtaatcactgatcattaaatactttcagtattttgttgttttatgtatgtcttataactcttttgctcttcatttccttcaatattgcctttgtgtttagcttatctttttgtgtcacactttgatccccttctcatttcttttttatattttctttgtggttaccaggaggacaatgtatcaacttttaaagttattacaattttatttttttaaatctctcccattcggggattttaggaaggttaaataataatgtaaatgagatacctagaacaatataagcattcaggaattattaactcaattccaatccttcctccacctccacctctttctctgtgagattatagaaaagatgacaaaaaggatgttttctgagccctttaattgttgagaatgatctttgagaaaaagaaaaaaaatgaaagcactaggaatgtacaacagcctggaagtataattaagtgtaaattaaatagataaaagttataagcagaggaaagtatagtagaactcagtatttaaaagagaatcaatgtgaaaattatataaatttatgtaaaataaaactaccagacaaatctgatatccttaggatttttctttctttcatgtgatttctaattgctacatatgacactaaaccattgatctgagctgtaagagaaactggaaattgttctgttatcttttgtaagatttctagaacattttgccctcagacttaaatgccaacgtatttctcacttattgtttactgcttttggatttacatatgatttgattctttcttatctcttatccttacaatgtaattcaaactgatgccaatttaagttcaattgcgtacaaaaactctactcctatgcagctccgccccatctaatttacattattgatgtcgcaaattccatctttgtacatagtttacatattaacatggatttatacatttttatgtatttggtttttaaatcctgtagaaaataaaaagtcaacacaccaatattaaaataatactggtttttatatttgtccatgtgcttacctttatcagtgttctttacatctttatacgggtttgagttactgtcttgtgtcctttagttccaacctaaagaactccctttagcatttttatagggcaggtctagtggtaatgaactctctgagtttttatttagggatgtcttaatttctagctcctgtttgaagtaaatttttctggatatacaattctctgttgattgatttttgttcattttcccttcagctcttttaaatacattatcccactttcttctgccttccaaggtttctattaacaaaattcagcttataatcttattaaagatctcatgtacatgagtggcttctctcttgctgttttcaagattctgtgactttggtttctgatagtttaaatataatgtgtcttattgtgggtctctttggatttatcctagagtttcttggtcttcttacgttggtatatccatgtatttcaagacatttgagtagttttcagccattatttcttcaaacaatctctcctctttggggacttccattttacctatattggttcttttgatggtgtggcaccagtcccctagactttgttcacttttttccagtcttttatttctgcttctcagactcaacagcttcaagtgttctgtattcaagtctgctgactctttcttcttccagctcaaatctgctgttggatccccccttgtaaaatttttaattccattttagtgtttttcaagttaagtatttttattaggttcctttttataatttctttttgttgatattctcattttattacacataatttgtctgatttccattagtttttttctttgttttcctttagctctttgaaaatatttaagacattttaaaagtctttatccaagttcaatttctatggttctgtagagatattttctgccagtttatgttcttcttttccatgggccatgttttcctgtttctttgtatactttctaatttttggttgaaaactgagcatttgaaaatagagccaactttcccagtttctgcagagagtctttatgccacagtattcgttcactgattaactgggtatatctaagcttagggagcagctgagtcaaaagtttaaggtcttctcaggtcttttctgagtatacatgtttcctatgcctgtgtgaaatgttctcaatttccctatataaacagctacttcttcttttttttttttttttgagatggagtctcgctctgtcacccaggctggagtgcagtcatctcagctcactgcatcctccacctcccaggttcaaacaattctcctatacaggtgtgtgccaccacgtctggccaatttttgtatttttagtagagacagggtttcgccgtgttggccaggctggtctcaatctcctgacctcaggaggattacaggcttgagccacagtgtccagcctaaacagctacttttgaatgctttaatttcctgaatagtctcaacccagtttttccttgaggtcttaggtggtccattgtatgtctccacccatagttgcttgccccaggcatctgtgggtctgtggtaccactgcagctttcaccacctgtagctgccacctttccctatctgagatccaggttaggtgagagagatcattccttcacgcagtcccatgacaggttggaacatttcaaataaggtctgttctgctcctctggttgaagggagaaaattgggaaccggtttcccaccttctacaaaccaagatctcatgttgccacgggagtggcagggcaagtgcaagtgaaaatgccatacaattttctaccattttgaacgcgggtttttcttcaatggtcatttgcttggttgctgtaggcctttcactgttttccagagctcccataagattactttagccagttttttgttctttcctgatgcttccctggcagagtaagggttggaacttccaccattttgctgattcataactctgtagtcagttttaaatatattgatacttgagtttgttttatggcccagaatatggtcttggtaaatgtttcacatatactcagaaagaatgtgtattctgatgttgttacatgggctgttctataaatgttacttaaggtggttaataatgttgctcaagtcttctatattcttgctgattttcttttatttatttattttattttttttattatacttttaagttctagggtacatgtgcacaacatgcaggtttgttatatatgtatacatgtgccatgttggtgtgctgcatccattaactcatcatttacattaggtatatctcctaatgctgtccctccctgctccccccaccccatgacaggccccagtgtgtgatgttcccctttcctgtgtccaagcgttctcattgttcaattcccacctatgagtgagaacttgcggtgtttgtttttttgtccttgtgatagtttgctgagaatgatggtttccagcttcatccatgtccctacaaaggacgtgaactcatccttttttatgactgcatagtattccatggtgtatatgtgctacattttcttaatccagtctatcattgatggacatttgggttggttccaagtctttgctattgtgaacagtgctgcaatgaacatacgtgtgcatgtgtctttatagcagcatgatttataatcctttgagtatatactcagtaatgggatgggtgggtcaaatggtatttctagttctagatcttgaggaatcaccacactgtcttccacaatggttgaactagtttacagtcccaccaacagtgtaaaagtgttcctatttcttcacatcctctccagcacctgttgtttcctgactttttaatgatcgccattctaactggtgtgagatgggatctcattgtggttttgatctgcatttttctgatggccagtgatgatgagcattttttcatgtgtctttggctgcataaatgtcttcttttgagaagtgtctgttcatatcctttgcccactttttgatggggttgttttgttcttgtatatttgtttgagttctttgtagattctggatattagccctttgtcagatgaggagattgcaaaaattttctcccattctgtaggttggctgttcactctgatggtagtttcttttgctgtgcagaagctctttagtttaatgagaccccatttgtcaattttggcttttgttgccattgcttttggtgttttagacatgaagtcctcgcccatgcctatgtcctgaatggtattgcctaggttttcttctagggttttttatggttttaggtctaacatttaagtctttaatccatcttgaattaatttttgtataaggtgtaaggaagggatccagtttcagctttttacatatggctagccagttttcccagcaccatttattaaatagggaatcctttccccatttcttgtttttgtcaggtttgtcaaagatcagatggttgtagatgtgtggtattatttctgagggctctgttctgttccattggtttatatctgttttggtaccagtaccatgctgttttggttactgtagcctcgtagtatagtttgaagtcaggtagtatgatgcctccagatttgtccttttggcttaggattgtcttggcaatacaggctcttttttggttccatatgaattttaaagtagttttttccaattctgtgaaggaagtcattggtaacttaatggggatggcattgaatctataaattaccttgggcagtatggccattttcacgatactgattcttcctatccatgagcacggaatgttcttccatttgtttgtgtcctcttctatttcgttgagcagtggtttgtatttctgcttgaagaggtccttcacgtcccttgtaagttggattcctaggtattttgttctctttgacgcaactgtgaatgggagttcactcatgatttggctctctgttagtctgttactggtgtataagaatgcttgtgatttttgcacattgattttgtatcctgagactttgctgaagttgcttatcagcttaaggagattttgggctgagacgatggggttttctaaatatacaatcatgtcatctgcaaacagggacaatttgacttcctcttttcctaattgaataccctttatttctttctcctgcctgattgccctggccagaacttccaacactatgttgaataggagcggtgagagagggcattcctgtcttgtgccagttttcaaagggaatgcttccagtttttgcccattcagtatgacattggctgtgggtttgtcataaatagctcttattattttgagatatgtcccatcaatacctaatttattgagagtttttagcatgaagggctgctgaattttgtcgaaggccttttctgcatctattgagataaacatatggtttttgtctttggttctgtttatatgatggattatgtttattgatttgtgtatgttgaaccagccttgcaacccagggatgaagcccacttgatcatggtggataagctttttgatgtgctgctggattcagtttgccagtattttactgaggatttttgcatcaatgttcatcagggaaattggtctaaaattctctttttttgttgtgtctctgccaggctttggtatcaggatgatgctggcctcataaaatgagttagggaggattctctctttttcctatttactgtacatttattccaccagtgactaaaacaggtgtatcaataaaatctgttccctcaggttttgcttcaggtattttgagggtctgttatcaggtgcataaacaagattgttatgtcctattcttaaattaatctccttataattatgaagttaattttttttttcttgagatgcagttttgctctgtcgcccaggctggagtgcagtggcacaatctcggctcagtgcaacctctgcctcctgggttcaagcatttctttgcctcagcctcccgagtagctggggttacaggtacctgccaccacgcccggctaatttttttgtatttttagtagagatggggtttcaccatcttggccaagctggtcttgaactcctgaactcttgatccacccaccttggcctcccaaggtgctgggattacaggtgtgagccactgcgcctggacctggcccgaagtaaacttctttacccttgctaatgatctttgctctgaagcatgctttgctggtattaatatagtcattccttctttctttgattcatgtttgcagggtatatctgtttccattcttttacttttaacctattgtctttatatttaaagtgcatttcttgtaagtataattggtttcttaaaatccaattatctgccttttaaatgtcatttttatatgatttgcataaatatgattattattacagctaaattgaaatctgtcatcttgctatttggtttctatttatcccatttttttcccctctttttttgctttccttgagattgaacattgtattagttttctagggttgctgtaagaaagtgacataaagtggatggcttaaaacaacagaaatttattgtttcagtttggaggctagtcatctgaaaccaaggtgtcatcagggccgtattctctctgaaacctgtagggaagaattctttcctgcctgttctagcttctagcattttccagcaattcttggcattcctttgcttgtagatgtatccctccaatctctgcctctatcataacatagccatcttctccctttatctgtctattcttctcatcttataagaacattaattactgaattggggcccagcatagattaggcctaatctcatcttgaataggttacatctgccaaagattcttcttccaaataagatcacttttacagcttttacaggtactgagagttagaacctcaatatatcctttggtggggaccgacctcttacccataaaaagtattttatatgattccattttatctcctttttaggttattaactacaatttttttttcttttttttgagatggagttttgctcttgtagcccaggctggagcgcgattttggctcactgaaacctctgcctcccgggttcaagtgattgtcctgcctcagcctcctgagtagctgggattacaggcatgtgccaccgtgcctggccaatttttgtatttttagtagaaacagggtttcaccatgttggctagggtgggtctcaaattcctgaccttaggtgatccacccacctcggcctcccaaagtgctgggattacaggcgagagccaccacgcctggctttataatttttttttaattcagtggatgttttagggtttatagtatacatctttatcacagtctagctccaagtgatatatccctttatgtatagtacatgacccttacagtagtgcatttccatttttcctctctggcatttaggctattgcacacacatacactcaattcatccctttgtgtagatccgtatttccagctgctatcttttgcttctgtctgaaatatatgtatgatttcttttatgactattttgagaaatttggttatgtgcatttgtctatttttcttatgtacttttagctcatcaatcttaagtctgtgagtttatagtttttaaaaacaaatttgaaattatttggctattatttcctcaaatatttttttctgccgcccctgctttccctttccttagggatctctgatttccacctatattactctgattgaagttgttccacgtctcttttgaaaatctctgaaaaatcttttatcatttggataatctgtatttgtacatcttcaagtacattaatattttcttttgcaatgtttaatctgctgttaatcccatgtagtggattcttcatctcaggtattgctgttttaatctctagaaattccattgaagtcttacttgatgaaaaaggcagataaaaacaaatgttggcaaagatatggagaaatcagaatctgcacacactgatgatgggaatgtaaaatggtcaaggcaatttggaaagcagtctggcagtttctcaaaaggctaaacgtagttcccatatgacagcaatcattcatctaggtatatactccagagaaataaaaacatatccacaccagaacttgaacattaattttcatagcaacattattcctaggggtttaaaattttttacattatttttatttaaaatagagacagggtctcactacgttgcataggctggtctggaactcctggaattaagcattcctcctgcctttgtcctgttttctccactggaaaagaataaaactttgtacacttggactaacaactcccgattccctcctttaccaacatgccccacagcctctagtaacttactctctactttcatgaattcaacttttttaagattccacatataagtgagatcatacaatatttgtctttctgtgcctggcttatttctcttagcataatgtcctccagattcatacatgttgtcttaaatgacaggatttaccttcctttaaaggctgactagtacttcattgtgtatatgtatcacattttctttatccacttatctgttgatgggcacttaaattgtttcaatgtcttggctactgtaagtaatgcttcaataaacatgggaatgaagatatcccttcaacatattgatttctgttcttttggataatactcagaagtgagattactggatcatatggttgttctatttttttcagaaacctccatactgtttttcatagcggctgtactaatttacattcccactaacaatgcatgagttcacttttctggacatcctccccaacacttgttatctttcatctttttcataaaagccattatataataggtgtgaagtgacatctcactgtggttttgatttgcattactctaataattagtgtgagcattttttttttttcatgtaccgaatgtcttttgagaaaggtctcttcattcctttgcccattttaaaatcaggtggttttcttgctcttgagttgtttgagttccttatgtattttagatatttacccatttccagatatatcatttatattttttcctattctttgagttccctcttcactgtgttgtttccattgctgtgcaggtcttttattttgatgccaccccatttgtctatttttgccatgcttttgcagtcatatccaaaaaaatcattcccaagaccaatgctgtggagatttccccctatgttttcttcagtaggtgtacagttttaggtcttatatgttaagttttaaatctatttttttatatggtgtaaataagggtctaatttaattcttttgcatgtggatatccagttttcccaacaccatttattgaagaccctgtccttttatacttttcagtatgcagatcttttacctccttaaatttacacctcagtatttaatatttgttgctattatgagattttcataatttccttttcagatagctcattaatagtagatggaaacactactgatttctgtaagatgattttgtattacggaactttactgagtttgtgtatcagttctaccaggttttagttttgttctggtggagacattacagttttttgtatatggttatgtcatcagtaattacagatgatttaacctattcctttcctattaggatgccttttttttctttctcttgtccaactgctctggttaggacttctagtactatgtcaaaaagtgatgagggtcgtacatggcctccatacctaatctgttgagagtttttaccatgaaaccaggttgaattttgtcaaatgctttttctgcatccattgagatgatcatatgatttgatttacaccctccattttgttatgtggtatatcacactttttgatgtgcatatgttgaaccacccttgcatcctaaggataaatcccacttcatcatggtgaatcattctttgtattcgtgaatccagtttgctaatatattgttgaggatttttgcatccatgttcatcagggatattactttgtaagtttctgtccttaaagtgtctttctctggctttaataacagtgtaacactacccttgtaaaatgaatttagaagtattccctctgcttcattgttttggaaaagtttgagaatttttattagttctttaaatgtctggtaaaattcagtagtgaagctgcctaatcctgggctttcctttggtgggatactttttattactggctcaatctcttttcttgttattggcttattcagatttgtttcttcatgattcactctttgtaggttgtatatgtctaggaatttattcatttctttaggtcatccaatttgatggtgcataacttcatagtagtttcttataatcctttgtattttggtgatatcagtagtaaatgtctcctctttcatttctgatcttatttgagtactctttttttctcctagtctaggtaagaatttgttgattttatctttcaaaaaaaaaaaaaaccaactcttagcaactcttagttttgttcatttttttccagtctttatttcaactgtgatctttgttacttacttctttatgctaactttcgggcttagtctgttcttttcctagttcctttaggtgaaaagtgagattgtgatccttcttctttattggcgtaggtttgtatcgctataaatttccattaggactgattttgctgcatcacataagttttgtttccattttcatttgtctcaaggtaattttttatttactttttgacttcttctgtgaactattagttgtttgggagcatattgtttaatttccacatattgctgtattttccaccagaattgattcttgttcttgatttctagtttcacgccattgtaatcagaaaagggatttgatatgatttctgtccacttaaacttaagattagttttgtggactaacatatatcctggagaatgttccatgggcatttgagaacaaaatgtattttgctgcttctggatggaatgtttcatatatgcctgttaagtccgtttggtctaaagtgtaattgaaatccattgtttctttattgattttctgtctaggtgatcaatctgcccatggtgaaaagtagagtattgaggtcccgtattatagtattgcagcctatctccctcttcacatcatttaaaaattgctttatgtatttaggtgggtcaatgttgggtgcatatacttttacaattgttatgtcttcttggtgaattaatccctttatcattatataacaaacttctttctttttatagtattgacttaaagtctattttgtctgatagaagtatagctacccctgctctcaatttccatttatatagaatatctttttccatcccttcactttcagtctatgtgtatgtttagtagaaaagtgaatctcttgccgggcgcagtggctcactcctgtaatcccagcactttgggaggccaaggcggcgggatcaccagaggttgggagttagagaccagcctgaccaacatggagaaaacctgtctctattaaaaatacaaaattagccaggcgtggttgtgggcccttgtaatcccagctactcgagaggctgaggcaggagaattgcttaaacccgggaggtggaggttgcggtgagctgagatcatgccattgcactccagccttgacaatagcaaaactccgtctcaaaaaaagaaaaagaaaaagaaaaaaaagtgagtctcttataggcagtatgtggttgtgacttaaaaaaaaaaaaaaatccattctgtcattctatgtctttttgttggagaatctaatccgtttacattcaaggtaactattggtaagaaactgctagtgtcattttgtaatttgttttctgattgttttgtaggtcccttgtttcttttttccctattgctaccttcctttgtggtttggtggttttctgtggtggtgtgctttgaatcctttcttttatagtatatgcgattaccattgtatttgctgtaaggctaacttaaaacattttatccttaggctactttaagcgataaaaacttgcctttagttgcatacaaaaactctacgctttcacaacccccccgcctttcgtgattttgatgtcaaagtttacacttttttaaatttgtatctcttattgtagctacagttacaattacttcttgtagctacaacttattgtagctacagttgtttttaatagtttcatcttttaaacctcctaataggaataacattgctttacctgccacctttacaatactagagaattctgactatgaattacttataccatttagttttttacttttatgtttctcattaactagcagtcttttatttaagcctaaagaactcccttttagtaattccagtagagcaggcctagtagtgacaaactcccttaggcattgtttatctggaaaagtgtttatttctccctttgccaagtaaagtattcttaattaacagctttgtttccttcagcactttgaatataccatcccactctctactggcctgtaaggcttttgctgataaagccactgaatctgtattggggctaccttgaatgtgatgtttcttatctttgctgctttcagtattctttgtctttgatttttgataacttggttgtgatgtgtcttggtgaactctttaggttgaatctgatcggtgacctcagcttcctgttcctgaattttgtcatcttttctcagatttgggaatttttcagctattacttccttaaatatgctttctaggcctttttctttcttttctccttaaggacctcctattatgcaaaagttagctagcttgatgtgtcctgtaattcttataggcattcttttttgtttttgtttctcattggataatttcaaatgtcttacctttgagctcattgattcttctgcttgatcaagtctgctgttgaagcgttctacttagattttcagttcagttactgtattctttatctttagaatttctattgtttttgtttatatttgttaaacttctcattctgttcagatgttgttttccaaatttcatttttctatccatattttcttgtactttgttgaacttaagaggattagtctaaattatttgtcatttcacaggtctccatttcttctgagtctgttactggagctttcatatccaatgtacaccagaaactttgctaattccacagtaaatgttagaaatgggtttttattgataaaatcagtggcttgctaattagtatgttagaagctggcttgcattggtgaagttgagggtattcgatatacgtatcccggctaaaatacttctaaagaacctctccagctttgcaagaatagagtataggaatctgaggaggcctttaacatggccctcagaaaggacacacagggcttgacctctaaacatataaacatatacagaaacgaggtcagaacatgttttgactgatgccagtagtaacacagcagagcctattgctggtcactgttaccaataccttgtgtaataaacctttcatttaaattgagaggttgtaagccccgaaaaagcaaagggcttacagtacctcttgcctgaacactcctgtgtgtgctttctaagaaatgcttttaaaataatgcctgtggcacaaattgatttgacactggctctctttataagctgctatcaaggttgtggggaatagctaactcttacccactttccctgacaaataggaacccgtagttacctaccaaaagtatgtaaaagctatatccgacccaaaggccagttaggtcaaaacaccttgaaaggagctcagtttaaggaaatcagtggtgtcacagtgccccactagcgtgtaaaagttttcatagtttgactatcggatgtgcttagtttcacagctgagtcttaccttgtgatacttttagagcaaaagtcaaatcaaagatgatttaaaaaaacatttcaaagattcataaagaataaatgcctcctcaggaagtcttctggagttctgcccacttcccttaggtggctctttactgtgcccatctcatagcctgtctccttccacttggtgtattgcagagtaaagctcactgtttacaggggtggtagaaagtgtggtcctttcccagactcctttttcccttcctcttctcatttttcagaagatgtgtttgataataaacgaaacaaaatgactaacacattgagctgagctacataagcagatgtcagtttgacgtgaagagtttaaaagatctatgcattatctggggactcctcccccagacctgaaggatcaggtgctgccttctatgccacctgtgcagacagcaaaagaggaaaaccatacccacgttcagtatgaacaaaggggacatttgaactctgtgtggacccctcattggaagggtgtttcttctcctgctgcatccacaaagagcactccttagccttgccttttgtcagttctctctccaataaggcttgagcagagacaacccagtgcagttcagagagactgaagtctggtgttccaggtctgagtcctagctctagctctctgtgtaactttgggatgtcccaaagtaacttttcacaacttgataggtgttaacttgaattttggatacaggtgactcttagcccatcccctctctgtgcttcagatatgtcatcacttgggccatatgacctctggacacctttcctactttccacaatttcagagcagcagagcagactggagctcctgctgcctctgagcttcagtgaattatcactcgttggagggaagcttcaagcattttgttatctttcaagagcaaacacagtgtctgtcagcaagaatatgtagcagatgctagtgaacagcagtgattagggttgaatgctggatttaaatatggagcttaggctgtgaaggaagcctgaagaacctagagccccatgaagctgccctctgtgagatctgacaccatttcccactgatgagccatgggtctaatgggtagcactgattccacatacagtatgtgagtgcaatacagtgaaagcaaagagaataaaatgatggctaacatgatgttccaaactttaaacaggagaaaaacacacaattccattatgtataagaacccacacagagatcaggagaataacctcattggagaatgaatgacctgtgtggggaatttagggtagagttgagattgaaaaaatgggccgaagtcaggtggccaagggccttaataccttgtatacaagatgtgtagtcaaggaagaccatgccttacttatgcatcaattcccttgggcctacaaagagctgcctagcctgggactgttgtagagaaaagctacagtgttccaatgacacagggactcctccatgtatgtatgagtgcccagctggctctgtaataaatcttatttttatttattaacttttcttgcgcattggcttgatgcatcagttggaagtcagaggccaaacgaagtgaacactgagccaaaggaagttctcagcctttagggaggcagaattcactttaaacacaataaacaaatgaactcacattatacaggagagagtcagaagatcccagtggctggtgtcatcgggccatatttgcccgaagtgcctattccttataggaacccactcccagggttgatgggctacatccttaggaggctttatgcctatgttctcctgaccactggctcctccagggctggccttttttagtctctctgtagaggttcctgtagctggttggatataggctttcacagaagggtcagtgccttgggtctggttacaggactgttaatcttgctttgttaagagtaatgttatttccccatttccaaattctccagggagatggaatgtcaaagatagtatgactgtagcacctaaatcctgggttccagaagcagagaagagaatacactgaagctgtagaaaggcctattagtccatgtcagagattaactggatgcgaggaccatttctgggatggtgtatacagaactggagaactggatagggagtcagaaacaaagagctgaagatgatgcctttgaagtttccaacgtggataactaggtcaacagaatattactcaagaaagtattaacataggattgagatgcagtcagtagtaatggaattgaaatttcaaagtatatacctcatggatctcagggggtgttgagctgatcacctgggctaacactcctatgaccctggggaaaatcaaatgacctggtactgtagccatggtaggggtgtcatcaccttaatccaactgggacagtgctgtttgatattcatctggaacttggtgcagacccacattttgctgggtttcaccacaaccaaggcttttttgattcttttctcttttaacatcagtacatcactgcaaagttaatcctcatataataggagatgaaactaattgcttataaaaacaagatttttacaacactaaaattgttcaagcatatgggcatatttatagttgcaggcagtgtttcagatgcagactgttcttggctgcagtggttgtttacaggcagcatctgttctgattaaatatttgatgattatccccgaatgttttaaagcatagtactgggctctgctgactgtacaacaaactggcatttttgacctatagggcactgggctaggagatacagttctgagggaagtgaaagatagttaacaactgcacaactgaccctttattagttgcaataaagcaatccaaccacccaacccactgtgatggctttcctactatttaaggttggtggtgtcaaagagacaccctcctgtacagtgtgcagtgaatcaacatcatttccacaaaacctccttcctgcacaaaggaattatcatactttgttacgaagtaaaattttcctgtatcagtcacaggagttcaccagttaagatactgttagttgaagacttctggggtgacttaatgaaatagctcagccatctggtttaaaaactggattcttctatccctccacacagctgtccatgcacctgcatcatctcaaggctggtctccctggtggtagaaaggctgacagtaaaaactggagccacatgattccttgcttaggcagtgtttcttcatactctcacatgagagcaggcatgttctttccctaggctcacagtaaacactctgtcaaatctcacaggcccaaagtgcttttggttatccccattccaagccaatctgtggcatggaagatagcattaccctgactgccttagactaatatacctactccacttctggggctgggaataattttgaggtcaaccatccaaactgcatgacagccattccatggaagaggtatggcctaaatctttggggcaacctgaattcatgaaaactctcttagatttatgtaactatttttagaattcacttctgtatcatttaattttactaataaaaataccacctttaccctaaatgtcagccaagcgtaaggctccgttgggacagaaggaactatcaaagctttgtgtttttatacattagcagcatttgacaaagaaataactctgaaggaaggagaataaccaggcagagtctagatgcatggaaaagaagtctttgagaaggcttcgcaggctgaaggaaagggcaggactacttcaggaatacaacgtttaagtaaaagaggttggggtctgttgatcttgaggagagatgaggatggactggaaaataggagtgagatatagtaggagaggaaaggatatggatgatgtatatactgtatgggtaaccatcagtcgaccctaagaagataatagttgttaaatggttagctatttaatgaaagaaacctgaacaagtaataatcttgagttgcaaagtggctggagtcacacaacagactaaatttctggtagaacaaatccagcagcttatgtgaaggttaccatgtctgaagctggatagaaaaggtctaacttccaaccaaagtcacagttcttgagctcggtacacagagacagactgctaacagctgatgtgtcctcagcgagagtgtcctcatttatatcctcgttctcttctgcctcctttttttgttttaaacttttgggaagtctcatcattcaatacagttctaatatatcacaataacagaggcggcccaatttctacaaattgactaattctatccctgaaaagttcatacaataaaactatacaaagcatcattttcaaccatcctatagaaaaatttccctattaaattttaactctaaatcctctatctctgttaataaccttactaaaaacttccccatcactgcctgccagggagatcaaaagaaaccaaatttaagaaacctccaacacctgtacctgactgaaaagcaaacatacagacctttcagtcctgcccctactattcagctcctatcacagagacatggtggatgtccccttgggaagcggatagctcttaggtggaagctaggcctgcaataagcaggccaggaaacatgtctcccaggccccatactcttggcagaagcacttggccaccagacagcatgtcctgtcaacctacagagttcttaaaaacaaacactgggacccagaatagtaccctgtggtcatagtgcccacagttcactaagcaccctcacaggtctttgacagaacactgactgccaggtcacctggtgggcagagaaatggaagattcccaggcccaactagcatctcagggaagaaccacaagcagagcaactttcagagctggtcggccagcgttggcacccagggaagcaagtgctattccatatttggagagaacataaaactcaaggaaacagagaagtcctactcaataccgttctcaactgaaaacaagagaacttgcaaaaaagaaacccagttttctggagtccatggagaaatatgaagccaatgctcggctaacagagcagaaagccttttataaataatgccagtcaaagctccaaaggtcagagctgatgcatgccggattgttctgacaatttcttaggtttctaggcaacaaggagctggtcaaacagctcacctccaaggacatactttataataccaccctggtagacgagagcgaggcagcagtgaaggcaatagtcaagaacaggagagggaggtaaagaacaagatgctcttcagacagtctggacaaagacagtccctacccagctctcaggagttgcctccttaagaaggtggaggcccaggcagctcccagggtgaccctaaagacagactccaaggaaaagggtgtgagggcaatggtgaatataaggaggtcccctttcagtaggcagagcaagtcagttcaggtcttatttttagagtctctgaacagtgaagagaagctttctgtggacagcattccaccaccatgggaggggaaaggtgccatgagagacttctccagtggggcatacaagcattgtgcagtgatccccaagatccagccactggcaggaaatcgaaaggcaagcttcttaaatacatagtatatggagacagaagtgtggagcactcccaaaatgaaaggccaagacccaggaacaacctccacaacctggagtatatacaaatgaacccagccctgctgactcagatccacaccatcctaaagcaggggtttctcatgaatgaaagggctaagtatttggtggagagaatgagaagtctcccactgcccacacattttttcttcagagatttcttttccaagagccccttgaataaaggaagggagggagcactgaatgccccagaaatcagaatgcatggtgcgggaagacgacaggaaatagttctcaaagagatcagaaaataaattggaagcaatttcattaccacaaagaacagacattttttctaaggcacccctcccctttccacccaattgtcattcagcaactactgaatacttaccaatgaaaaacgttacccctgacctcaaggctgctcctgagctctggtagaaaatgctttccttgtctataaaacatggcaagcaaggcaggatttaacagtaagggcacagtagcactgcaagccttcaaatggaaacctggagacaagcagtgagaacaggaagcaaaagcagggcaggtgaagctaggaccagggcatctggaactttccacacaggttggatctccatgccagacaacagttttcaaggaaaaatatctaagaggaacatgactttgggaaactttttggcagtactgcttactgtatactagagagtaaaagaatttggggaacattcaccaatttgcttcttcaggggcttgggtagggaacgtgaacaggaacctggctctaatttctgaacttttttatcagtaaaaacaatccaacaaacgaaagctagtcagtgagagaactgggagggtctgccctccttccctgagtcaagccttctggggggacctcctgacatttaattaagcaaagacaacgcccactgaaggaagctgacctgaaagtgacacgctactgtgaaatgagcatgaagtgggagcttgttacatatatgaaatggccagcgatcctgagcaaagcgcttcagagcttgagacctaagtcttctcatctatatactgagggctggacaagatgatctgtcaagccatttttatccctaatccaccaaaatccaatgctttagtttattgtcacaaaagcaggtatcgaatggctatcctgcagtgcctccaatcaacattcagactttttccctgaggcaatataagataacagttaacatgtttttatcaattaggtggtcatgagataaatatatatgggaagtggtagtttttcacttaaatgcatataataatggtacagctctctttgaatagtatttgtttatttcttaaatatttaagttcctaaagacggtaagaataacccaaggaagtgaaatcaatgtcacaaagcacatggctaaataactgcaggtttgcagtgccatgtgtgagatcagatgacagaagggagaactacctttaggcagaggcttctcatgtcccctggagtggccatgtgctgttctacatgactacttccacttcggttatgtagaagctatttaaagcacacagatgtttgtgatgagaaaaaagccacccttaattgaataatggaaattataagcatgatttgagggtgggggtggaggtgggagtagagatgggtagaaaggagtgcaatggaaacaaaggagccttcataaaattcaagtcacttcttaggataacgtgattgatttactcaccaccttcttaggaacataaagcaaacaagtgggttttccttttactgcttttctgaaatgagctacactcaagaaagcagcacgggggttgtgctgtccctgcacagtggcaggagagtatgaggagcaggtgaatgccacaacagctccatccaagatcatttttcacatgcaggaaccattcttatactaccctttactggtaatttctgtagaaatctggaagtctggttgacaccctcctgtacagtgtgcagtgaatcaacatcatttcccttggactttgcaatcacggtggcattcatacattcattcaacaagtatgtatgtacaggacagtggagtaaagaaaacagatagttcttactctcacgaggcttaaaatttcaggagggaactaggcagtcatgaagtaaacataaaaacacagattgtaataggcactagagaataatgaagactttggggaacacaatttaaattggaaaaatatctcagttccgttaacacatgttgaaggggaatagcattgttttgctggatttggggcctggatgcaagcatgttgggtatgcattgtagggtaatgcatttccttccatttgggcccaagtgtatatttaccacccagttgtgatgagctgggatcctcctgctcaatctcagcttgaagcacttggaggttatctgcctgctgtgggtgattattttggagcaaggtacttcatttgcctcaagaaacagatttgataccactactgtgcccttttggaacagagaagtaggcaagaccccagtgtgaggcagagtgatgggatctttagggacataattgatgatgtaactgatgatgattttggagtttatacatttccaaagtttcaaaatattttcacttggttgatttatctttatggtgatgacactacgtagatatatgcccttcttaaaagttacagtaagaggctgggagcggtggctcacgcctataatcccagcactttggaaggccgaggtgggcagatcatgaggtcaggagattgagaccattctggctaacacggtgaaactccgtctctactaaaaatacaaaaaaattagccgggcgtggtggcgggcgcctgtagtcccagctactcaggaagctgaggcaggagaatggcgtgaacccgggaggcggagcttgcagtgagctgagattccgccactgcactccagccagggcaatgagcgagactccgtctcaaaaaaaaaaaaaaaaaaaaaaaaaaagttacagtgagagttgacattgagaaaagggaggcccagccagggttatgcaaagacacagtagggaggaggatgggaagtttctgagacaccccagtaactgcatgggtccacaaagcacatgtacagtctgctctatgcactgcaggtacagccacgaataagacaaagtctctgccctcatggagcttggtgtctgtctactggagcagacaaaaacaaacctgctttttctcatttgcctctactgtgggttccgtgtataactctcaaatgctagcatttccatgcattccatccttgtccttctctcctctctgccttttccaggagaattttcctagccacaggttcagctatggtctatgtgctggagtcatacatttttatcttctgtgtacgtttttctctagacccatatttttaattgccttaggacagctctccctggatatccctcagacacaactaaaacatcattcaattgtactattaataattttcccttcaaaatccactcctcttctctatagacctaacagcaacactgtccgtccagctctcaaaacctgaaatgtgggagttgtctttgactcttatctttcccatgcatgagcactgaatcaatcagagtccctagcatgtcttggactgtggcctcccttctatcttcagattatctgcctttttagaattatggcaataacttaactgcaaagaccacatgtgcacttgtgctctttcagtttgtaataaatataaaatgaaaagtgattatgtctttgcttaacgtctgcaaaataaaagtccaaagtccttggtatggtctataaggccctcattatctgacctgcctgccttcccaatctcatcttaatcccttacagcctgacactcagacatactagactttccacctaactcactcacatacacctatcctgtatgtcaagattcggcttgaccttcatcacctacctatctgcagtatttttggatctgaattctctgcccacattgtactttcacatacttcttttacccttagtggtttgtacttatgcctggtctaactagattgtctccctgtaacagacttcttgattcaacaaagcagctctgaatcagcctgaaacctatggcacactgcaaaatggcaaacattcaataggtatttgcccagtaaatgttaatgaaaggaaaaaaattcaaacttcagttggaataggattagagacaagttaaaaaaaagtttcccatagaaatcttcctcatcgtaaatatcatcatcctaaatgtcccgagtctttccatgggtctaatttaccaaatcatgaagactctctttctcactgtgtatgtgtagtgggagaggcagagacagaacggtttttttttttttttgcaagtctgctctctggattcgtttttctggggatgaaatctcaggctatgtagcttttctggtccctttttggtaatcaacaaatcatcagtttctctaggtattaaaaagcctacacttttgaaacaccaagaggccaaactctctcttaattgaaaacataattctgcctcttactgaggtctttgggtgggaagcttaaagacagcagtgttggggcaattggtttttcttttcctccctccaccttctttcccattcaagagctgttgctgccctttctggaggggagggaattagaaaaaaagatcctgccttacccagtcactgttaattattactttgagccagggtggggaatgactttctttcctggaatacaccctgctggaaaccacagctgagattctctaagctggcagcttccaacctctcctccctcaacagcttcaacattatatggcactcagctgcagggtgcctggctccaggccggcagtccatttgtgcagggtagttttcaagatggctcatagcccatctctttcagtgaccagcgtggcctatgggaaacatacatcttgactccattattggtaggagtactctttagttaactgccacaggccagttcagacacgtcttaccctgagagccttttcagagtcaggtaccatccctgtgtcccccagcatctgaagatcacaggtgaaggtctccaagtagttcacttaaaaaatacctcagtaggtttaagaacagggaaagctcccaattcattctgtcaggagtatgactctcatccccaaactggacagatatataatatgaaaactacagaccaatattccttatgaatatagatgcaaacattctaaacaaaatactagcaaaccaaatccagcagcatagaacaaggtttatgtagcatggacaactgagattatcccaggaatgcaaagttaattcaatatacaaaagtccattaatacaacatattaataaaggacaaaacaacatgaaaatcttgatacagaagaagcatttaacaaaacccacagcccctcctttttttttttttgattaaaaaacactcagtaaactaggtttaataaaagaatttcctcaacttgaagcaaacccacagctagctaacatcatactcaatggtgaaagactgaatgctttccccttaaaatcaggaacaagaaaaagatgtctgctcttgtcacttctatccaatattgtactggaggtgctagccagcacactaaggcaagaaaatgaaataataggaatctagactggaaaggaagaagtaaaagtatttctgttcacagatgcatgatctcatatgcaaaaaatactaagtgacaaaaaaagaattttagaaaagctacaatatacaaaatcaatatacaaaaattaattttatttctaacaccagtgatgaatacaaaaataaaaattagaaaataatcatataattaaagtggcatcagtaaaatacttagaaaaaaattaaagacgtcaagacttgcacactgaaatctctaaaacatcactgaaataaagacctaagcaaatgcaaagacatcccacagtcatggaacagaaaacctaacaccattaaaatagcagttatttctcaaatttatctaccaattcaactaaatccctatcaagatcccagctgttttgcaggaattgacacaatgatcatataaaaattcatatgcaatgcaagggacccaaaacagacaaaatgattttggggaaaaaaaaaaaaaaaatggaggacttgcacatcccaaatctaaacttactaccaagctacagccatcaagacagtgcggtgctggtataacgacagacatatagggcaatggagtaagactgagaatccagaaagtcttatatttatggtcaactgttctttgacaagggtaccaggaccattcatggggaaataatagtcttttcaacaactggtgcttgggcagatggatatacagataccaatgcacttatgcaaaaaatggatgaaataggaaacttcactacattctactgcatgctcggtcattttcaatcatttaggtggcaacactgacaagataacagaaagatggaggtaataacatgtgaaaggcaaaatggtttgtttttttttttaaaaatgacagtctctatcatgaatttacttacactccaggcaaaggttattagaagaaaaaaagatgtaagaaaattccttaactgaaatgtggaaagagtatcaagaggagaccctaagacactctgtaagaatcccagtgactcctcactgttcaactaagaaatgtaccccattatgctgtgctaccacggaagcattggaggcactttgggggttgatgaagtcttcatggatgaggtactttaaatatctggtcatgaagagtatttgagaaatatgacaagtgaagatgctgggtaggaatgcagcgaggaaagtgtgtaacacaaggccaaattggaaaggtcagtgagggggcaatctgtggaggcactgaatgcagaggatattaaaattagcaagatagtgttctagcacaatgaaaaggattggaagagggagatgagagtcagggagtgaaattaggcagctgctaagaatgtccgggtgagtcagaggatcaggacctgtaagggcagtataaagaaggaaggaatgatgggagaggtttagggggaaagaagtgacaacctgtgacaattgaggaatgagagattttgatgattggggtgaaggttacatttcttaaaaagaaacaaagaatggtcggtcgatagagatgcaagatgaagaattttgtttttaggactactgactatgaggtaacaaagaaatcccagagacagaggtctgagcaaaagatatgggattggggaagaatctttgggagtgactgaggttgactagagggaactgggcaagaacaggtaaggactttaagcagaattggaggagtatccatctaaaatctgggtaaactgggatggaaaaacaagtagccagagaagcaacagcccaagctagggtgttgtcaaggttatagatgttactgattttggcaatgaggagattataaggatccttgaagactgtactttcggtgaaactaccatgcattagtagcctttcacagtgatatctaccccacacctgcatcaaaatcttgcagtgcctattaataaatgccaacccactaacggggaggggagaaaagacttgggactctgtacttgtaaaaccctctaccctccccaggcaattctttacacactaacactgttgaggtaaaaggagacaagtgagggagcaaatggaaggtgtgtttttggattatacagtggctcatggaagggtgggaggggtacagatggcccttagacactggcggaaagtcagagaaaaaaaattacagtaagcaggtaaagggatcaagactacacagggactagtcttgggacgacatttcttcctctgacagtttgtatggaattcttgagaaaaattcctcgaaggggcctgaaatctcagaatggtcatgtttttaatgggaatagggagtgatgctgccccattacaaccatctgttctaacagaatgtctgtaccgaggagggatgagtaacatcggcaagttctgttcgaagcctttttcaagtttctttttgatatgtatctatctatctatcatctccctatacaagcaagcatccccaaaagtagttgtctcaggaaaccagggttaggatgaccagctcatttgctggagctgccaaggtccagaaaagtttggctgcaggctgttttcatgttttatgtatgtttgaaatgttctataataataaaaggttaaaaaagtttacatttatttggaaaaccagttactttagtttatggttcctttttttccctccagagcttcctggagattgaggtctaattcaaagaaaaccaaaatatataatagagtacctgggcaaaaaaagtacttttataacataacatttggggtagaggaagtatccactgtagtcaaaatgtctatgttttgctcttccttattgttcagggacattccattaaatagtaatgaaaaggcagcaaaagtaagaggagtgacaacatgcccggcataattaagcaagctagagcagctattctgtgcaaccgacgattttttttctctaaaattttaagggtaggttcattctgactctgttaaaagtctacttgatgtgaacaactctatatctgataacctatttcaattaccactttaaaacttgtcatatggatacgttattacaattgtagaactttaataaataccataataataaaacttgagaactgaagagcacacatttcttcacgaatttattatataaaacgccctcagagtatttaatttctcctcactttaattacacattaagaagcacagtggatgagaagcctttaagatgactacagttgcacgaaggtccctttcatcaaggtagcgtatgtaccctaacagtgttctaaaggctggcccagaaaaaccccatgttaccttatcacaatatggaaagcattgtcttctttttccactaaattaaattatggtgaaaagtgccacagttttatttagcattatggtacataacaaacagttctgtctcaattatgaaaaaaattaattaaaataatcctgaaagacatcctttttctccccccaatgatttgaaagctgcatttttcctgccaatttcaaacaaacaaatcatcaggttgatctacagtaatcagttaaaacaatcagtcaatcaatcaatcaatcaccaaggcacaagctcagcacattagctatagcttgtagcaaaaggatatatcaatgtctcaccttagttaaaaatacataatccttttattttataatgcaataaaagaaattaacaacatcacatacacagaagactaggaaaggggaaactacttacttctggaaatcagtaatgtaaacctacttgtacttttccatagtacatgaaagtaacgtttaacatgttttgaattaattaattaaatttaatctgtggggctatacaatgtaattcttaggagtaatagtttcattcatttccaggtcagcttactgtatgattaagtaacacaaggcacagtagccatctttttcattatgttgcaacactgatcacgtgcctcgataaaatggctgattcaacaagatgatggcaacacgaaggggagactttggattgtctatttaaaatctaggtaataagtaagtaattaataaaaactctatcttaagtgcactttcacatgctttttgtttataataaacaaacaacaaacttcctaactttgttgcaataggcttgactaccatttcatttggccaaatgcactttccccagtaaacttaaaacaacaacgagaacaacaagaacaaaaatccctgtcctttcatatactaagaaagaggattggctactgaaacagttcattgcaagacacatgaagacgacatactgtggcatgagttgtttttgtttttaatttgttgtgctgttactaaagttctgagggctgcagttaaaacattccaatttctcccttccttccatctttctttattgattgattctcaagattttgcacagaaaactctttgggggctagaacagcagtaattgcatcacactgttttcaagacttcaagtttcaaaagcaaatcattaaaaaaaatacagttcctgatttgagttagatacagggacaaaaaagtagcacatacttgaaggttacgtggtctacaaatggtggcaatattttccttgggagagtagttctgttggtatatattttttaaatactcaaaaggctcaacctcaagcagtaataaacacaagcaaaagtgatttaacccttaaaataaatattcagaaaaacctctctgtacatacaagtgaaagaatatgtaacactttcacgcaaaaaaataattataataataataaaggatttgttcatatatgtagctgaaatctgctgttccagcccacatgtccccaataaagaagggaggcacagacataggtgactactgtggttgactatcttacagcctttttgtactgggacactatcaccaccaaaaatttatccctcgttatatttttaaaattttttaaattttttctttttttttccttccttttttttgttttattttgttttgttttgttttacagcatgccaaatcctttggcatacgtgatggccttcaacaatctctctttaagtttttctttgcttgagtattccggaagtaaaagcacattaaagcaagtatgagatgtaggtaacctaaatagagaaaaggggaaaaaaacaggaaaactgtaagtcatgggaaatacacttagaattaaatgctcctatttttagattgtatatagttgagacggtctgcaatgcaaactatacattaatgcaaatcataaactttttgttgtgtaactaccaagttgcctttatcctataaattactcaaagctagtgacgatgataagatactgtatccattgagtttttactacataacagataccattttaggtactgaattcttacagttcatttaactaaatctttccacaacaaaaccacagagaggacatcagtaaatgcactttagaggttaggtcactgagaagtcaagtaacttcctctaaggtggagaaaatactcaaacctgttttacaagactgcaaagtgtgtgctcttaaatgcttattagaaacactgctggcaatatgactaagaaaatgatttgataacaggattctagcacaatcaaatgataatcttccgagcctcaatgtaaccattctaaatagatgatcatgttatatggctttcaattaacaagctgggaatcaaaaaagtaaatgaatcacactaatttgattccaaaccaatgtgagccccataataatttttaactagggcaatttcttaaaagtttcctcacacaatgacagcaaagtattttctcaattgtctaatatgatttggggatttgtatataaaatcacgaatgtgctcagaaactataaagacagttcatatgtatgtgacgaggaatgcaaggttttcggtaggtatacagtcacaagttaataattacctacctttctgtgtctgggccatttttggctataatcatctttaattttcctagtcctcccacaggtgctctgtctgtgcccgttgtaaactgcaagaagagtcttttctgttcatctgtaaatgaatgaacgatttcccagaactccctaatgagaaaaaatacaatactggtttcagtttggcattcattatgactggtactaacataagcttatgatttgcattaaaactatattaagagacaacttggaagttaattatcaggatagtatcacttctggtgatttaaaaatttccaagcaaatttatcctgaacagctctgaatacgtaaaaatttagattagattacaatatagtaaaatattagtactacaatagtaaaaaattgagaaaacccaagtgtgtagtaacaggaagtgactatttaaactatggtataatcacattatgcagtcagtaatgagcaaaagacaaaatcctatgaattgaaaaagactgaaatgaatatttggaaaaattaactccaggtgcctttgggtatatattttatttatcctttctcctttattctcctggtctactcatcctttaactcaactttgggaggaaaaagtgatacagattaaggacaaaagaaaaaaagaccccctgccccaaccaactggccccaaatgcaaacaactacatacctaatagcagtaatacaaaagttcaatttttatatgaactagaatactttaaacaagtaatatgtgctgtgtatggaggaggagaattattctgacatttctgccacctgcagttattttaagagaatgatttatcctgtggcattcctaaaatctatgtaataaaagctatgttttaatgacacttatgttagtttgagttctaaaaaacgaaatacaagctcataaagtgcaatcttgaagtttatttgaataatcaggcatctataaaacatatatacactagttcatagctaaataaatttttttttttttgagacagagtcttgctctgtcgctcaggctggagtgcagtggcgcgatctcggctcattgcaagctccgcctcctgggttcgcgccattgtcctgcctcagcctcccaagtggctgggactataggtgcctgccaccacgcctggctaattttctgtacgtttaagtagaggcaggatttcaccatgttagccaggatgggtctcgatctcctgacctcgtgatccgcccaccttggcctcccaaagtgctgggattgcaggcatgagccaccgcgcctggcctatagctaaataatgttaagattaaaaaattaaaaaaaaaattaaaagtatttttagttgcttatataatataaaatgcattttaatagttatttagaaagttctttccagagccaggtgtggtggctcatgcctgtaatcccagcactttgggaggctgaggccagtggatcacctgaggtcaggggttcaagatcagcctgaccaacgtggtgaaaccctgtctctactaaaatacaaaaattagccgggcgtggtggcagatgcctgtaatctcagctacttgggaggccaaggcagaagaattgcttgaacatgggaggcggaggctgcaatgagctgagatcacaccattgcactctagcctgggaaacattttgagccatctcaaaaaaaaaaaaaaatttcatctcaaaaaaaaaaaaaaaaaaaattccagaatgttagcagagaacatcacacatcccaaaccagtaattacaattttctaccttttgatattctaatatcccaacatactatttttattaccaaaatgctggcatttttggtgctgcaacaccatttatctgaaataacttaaaagttttattagaattcttggctttctccaatctcttgccacttcccttccctgcccctttacaaatccaccagtcagcaagagaaaacaaaaaagaaacacacaacaacagaaaactggacatgaaacttgcaggagcatctctcaggtaaggaggagaggaatcggaccccagttcatgatactccttttggggaggctgacaagagaaaacaagtctgctgtagcacagaaccctccaacatagcagaaaagctgccctgcagtgggtggtaataaagcctcctcacactgcaggagggctctgaagcttaactgaaccagctacacctaaggaggtagaccaaagagcaccaccgaagaacagagacagaccctgcaggaagtggcagatcagcagtggtcacaatgaccagtctggctatattattacggagctgtttctttggacttttaaacgaaacctttaaaaattttatacaatgaaaacagggaacaaaatgcatctctattcctataagtgttatgtgtgttacattaacattttgaattaaacaagaatgcatatatttagaaagctgaagaaaacacgaagaagcttccaggtttccacataaaagtggtggctgtatcgatcacatcctactcacatctctaaaaatctacccggatcaaaaaggggaaaataaaaaaaaaacctatgacttaggtctagagtaaaactaggagacagaacaataaactccaaataccaaagaagtggggaaatgagcagggtccagcaggagctacatcgaagagtggcttgtgcggaatcatactgattagggatcacccaaggccagaccccaccccctccaccacctgcccctcaacagagcactactgagtgtaggttagagcactggcaacagggtggttaaaggaaggactacagaaaagtacttgggtccagcaatggcaggctcaggaaggcaccatgcatgaaaggaaggggggtaccttcaaaagcagaagtgtcccttaagcggctgtaaaggggtggaagcagctaatgaaaaagagtcttcattaagctacatggagctgaaaaatcagaaagtggtgattctgcccttactaaagcaacagaagagggatcccttcaaccaagacccctaaagccacacaattcctccctgctccaccatgaggtctagtaataacaggtccagaaaaaagtaacatctgttatagaaacataaacaagaaaaacagaattcggaagtctaaataaagttattatgggaagagtctggcgaatgagaagcaaaactttccggtagacaaaagtagaccagaaaaattcagtcataaacaatgggaaactagtaacaccacattccaacacaaaaggagaatgcagcagcagacaagacagaccaccagtgatgagaaatacaaattcagaaagaaatgagcacatcttaaataaaaataagaatactaaaaaatactgaagaaatatgcaaggtaactttggaaataaaggctaattttattataaggtgaccaaagaagaagcagtatgactaaaatttctactgaggacagactctagaaaattaaaaaacaaagaaaatgaataaaataaacataactaaagaaatgcatatcaaagcataataacgaaaaagattaatagctaactacataaacataaaacctttcatttggcaaaaaaatcctataagcaaggttaaaagacaaatgacaaactgggaaaaaatatttgcgaatttaccagcgttaaaggactaatctccttaacatataaagtttctaaaagtgaagaaaacgaccagctgagcagcaaaatgagcaaaagactatataaaactataaacagctctacaagaaaaaatgtccattatcattcataattgaggtaagctcaaaaattgtaactatagtaaaataccatttctcaattggcaaataagtaaacatccacatttaacaacacattctgtttggaaagttttaagaaaagagatactgttgtaaactgctggtgggaatgcaaaatgttatttttctgtgaaggaggatttggcagtatctagcaaaattacacatgcatctaccatttgatgcaacaatcccacttctaacaatttatcttaatgatactttacatatgtacggaataatgcatgaacattaagaggattcactgtgacattagtactaacagcaaaaggttaaaaataacctcgatgcccataaatattgataagctatgctgcatccacacaaaggagcagtattcagtcatacaaaacaaaatggaaaacacctctgcaataatgtgggatgattctcaggatacactaggaagattattttcctagttctgtcctctgataaggcctacaagcagtaacgttcaaaagcaaaggccatactttgcatctaaaatctgacttctaaatgccattctccaacaatttattggaaaaataacttattccaggcctgagaatgaatgttcgagattagttagaaatctcaaaatctaatagggtcattttaaaagcacacgatagctaagcaatttgaatatcatttagagtaatgactgtgaaacgtattaaatacaaaaacattcattagttcgtaatattcaaaaaggcagcaaaaaccaaccaaaaaacaaaattaaattgtcactattaaaattattacattaactccttactctaaaaaccttaaatctattttatcatgccttttctgtagaactgtttttcaaggtaatcaaatggcacccaatgatgagaaaaaagaatgccaggtatatatgtaggacaagcagatggaaattttttttccccaaacagccattttgcaatccccaatgagataacagattaaggtaatgatactgataaatacgaaaatcaggtgaagggcaggtagcaggttctggaaagatgatgatggcaacgacatagttattattattattattttttgttttattccctcccaacctcccctacaaaaacagcaaactgaatgagaaaaccaaagacccagagacattatctacaacaaaaccatgaaccattgcatataattggacagaaacaaagctctgacaactacaagactggttagtaaggaagcagatgcaaggtaactgactgggtttctgacagccctgagaacactgccaacccactggaaagcacaggccaatctgaaaacagggcttaaagttttaaaaagttctacaggatctaatttgcagatgattacaaagggatcatgatgtagtaagctctgggcccttaaaacacccgaataccaaacccccaccagaaacaaaccttgtaccgaggaaaaacttctgggaataacttccgaatggaccaggtcagtaataaaaaccaaaaaaaagttcaaatatatgtgtgggatagaggagtaaagaaggcagtttcagaaagcacaagggcatatttttgaccattttacaaaaacacagacttctcctcgtccctaaaaagcgaaaaaagttatcctggcccatctctccctcgtccaagtatgagaaactcatttcactcacacacacacacacacacacacaaataaataaataacagaacagagtgaaacagtgtaattattagagaaaaagtatgtgcatatacatgagaatggtgtccctacagaaaatcaaagtacatgaaacaatatgcaaataaaacatgaaaactgtaaacaaatttcaaactgagctaaaaagaatttaaaaaataacaaatcattagaaatgggaaatttctgaatgagggtaactgaaaaaaaggaagacatgacacaactaaggagtaattagaaatgcaaggaaaaaaatcccatcaaatacaaagaaactaaaactaaactagaagaaacataaaggtgaataaaacagaacaataataccagaacctgaaggcagaagaaaaatcttaaaatcaaaaagaaacaaacccatgcttgagactctccttgctggtccagagccacagtgctgctgtgtactggcaggaggaattctgctataattggtcctggcagtgttcacctttcctgcaagtgttccacagcccagggacacaatgtggtcaggagcactgccaggaacaccagcaagggggagcctgccacaacaggcacaaggctcaggaagcactctccagcccacgaaaatctagtgggggtcctcttccctcacccaaacacactctgcgcagctcagcctggagaaggcccctcaagcagcactactaggaaccagtgcgagccccagtggactgagataaaagcaacaaaccaaaacagcaccataaagcctctgaaaaatggtcactggaaccacagctcacaaatatatgctagtacctacatgctataccttaacaggttactactgaagttaaaatttttaaaaagtacagagtctcctgatataataactaaaatgtccgagacacaatccaaaaattatctgtcataccaagaaccaggaaaattacatgaaggaaagaaaacgccaacactgggatgagtaagatgctgaaattatctggcaaggatcttaatgctgccatcagagaaatgatttgacaagcaattacaagttctactgtttcaaaaacgaaacaatagaaaatctcagcaaggaaacaagatacaaggaaaaaaaagcaaatggaaattatagacctaaaaaatacaataggagaaaaataatcattagatgggctcaacagtagagtgaagatgacaaaggagagaaatctgaacaaaagagagaaaatagactgaaaaatgaaccatgcctcaggtccatgtggaacagtaacaaatgactcaacatttgtatcattagaggcctagaatggagaaaagagtgacgctgaaagaacacctgaagaaataatggttgaaaattttccatgtttggcaaaagacacaaacttacagcttcaagaagctgagcgaaccccaaatagcacaaataaaactattctttgggaataaagggaaaataaagtcatcttcagaaagagaaaaacaaaaagaatttctcactagcagaactgcctttgaagactggctaatggaagtaataaaagatggaatcttggaaaaaataatggaaatagcagaaacatgggtacatacaacagagcatcactcccttgataagttctataagtcatattggataactgatacaaaaactgtaatagcattaatcctcaaaacaatactatttaaaagtggggaaagagacccaactgaaattaaggtttccatatctcattccatgtaatggtattgatggcagtgaatggtggtaagtcacattatctataatgtgatacccacaatgaccgtgaaaacaactataaaaaacacatagaaggccaggcatggtggctcatgcctgtaattccagcactttgggaggctgaggtggacagatcacaaggtcaagagttcgagaccagcctggccaatatggtgaaacctcatctctaataaaaatacaaaaattagccaggtgtggtggcatgtgcctgtagtcccagctacccaggaggctgaggcgggaggattgcttgaacctgggaagccgatgttgcagtgagctgagattgtgccactgcactccagcctgggcaacagagcgagactgtgtctcgaaacaaaaacaaacaaacaaacaaaacaaaacccaaacactaaataaatcaagggtcttaaaaatcttaaaaaatgttcaagtaatcatggaaggcaataaataaataaccataaacagaagacagaaacagaaaacaaataataaaatggcagacctctccctaacatatcaataattaccttaaatataaatggtctaaataaaaaaattaaaaggcagagactaacagtttttattaaaatgacaactatatgctgtttacaagagattcgtttcaaattcagcaacacaggatgaaagtaaaatgatagtaaaagacagatcatgcaaacattaatttaaaaaaaaacaaatggttacactcatatcagattcagagcaaagaaaatcgcaaaacagaaaaaacttatataatgataaaggaccaatcaccaagacatagtaattctaaatgggtatgaaccaaatgatagagcctcaaaataaatgaaacaaaacctgataaacagataaatctcagaagcagacctatataaatattctcaagtgatttttaacgtatgtgaaaaaaacaattcaatgaaggaagaacatacctagaaaatacataaggaacccttaaaactcaacagtaaaaaaccaaatggactcttggtttttaatcccagagaaatacaaactttttgtttacaagtaacatcacagttaatggtaaatattatagtctctctcaataaaatgaggaataaagtaagaataccttctaccaaaggttctagccagtgcaatagaggaacagtaataaataacataaacattggaaagaaagaaacctgtcttgatttgtagatgacatagctgtttactagaaaaccctatgaaatctactaaataactactagaataagtcaatttagaaaggttataggatataagatcaatatataaaaatcgattttatttcaagatagtaataaacaagtgaaaagcagtatttaaaaaataccactaatagcattagaaacatattttaagtttattcctaaccaaagagtacatgatttcaacattaaaaactataaaacagtgctgagataaactaacaaacatctaaataaatggagagacgtacggtgttcaaggattggaagaatatattgttaaaatgtgaattctctccaaattgacctgccccagtcaaggcaacccaaatcaaaatctctgcaggctttgcccttttgtttgtaaaaattaactgattctaatatttatatgcaaataaaagtcaaagcaacctaatgaaaaagttgtgggactcacagcatctgatttgaagctgcagtaaccataacagtgtcattttggcaaaaggacaaaacaaattaatagaacagaatggagaatccagaaacacggctcacacacagattgattttcaacaaaggtgcaaaggcaattcaatggggaaagaaaagtctctttaacaaatggtactggaacaaataaataaaactatttagaaaatgaatgacatccactgtctaacagcatcacaaaattttattggtggtggatcacagatttacacataaaagttaaacctatattacacaattagaagaaaacataagatatttgtggctttgggctaggcaaagatataaaaggacataaaaaaccataaaagaaaaaataaattagacctcaaaaaatgaataatttctgctcaccagaagacacttaagaaaatgaaaacttggagaaaataatcataaactacttatcagaaatgggccttttatatagaatatacagtattccccacttacccatggggaatacgttccaagacctccagtgatgtctgaaattgcaaatagtactgaaccctgtatatactatgcatgatttatttttccttcttcacaatttcatagatacaatactcatttttaccatagattttagcaacctcaacatatgatttttaaattctttccttaaaggaagcactttccagcttctctttggcatatatattcgaatttccaacatcactgctcttgtgctttagggccattattaagtaaaataagggttacttgaacacaagcatgtgatactgcaacagtcgatctgataaccagtagactaaaagtggtgggtagtctagacaacaacgatatactggaaaaagggataattcatgccctgggtggaaaggtgggagatttcaccatgttactcagaatagcatgtaatttaaaacttaagagttgttggctgggtgcagtggctcacgcctgtaatcccagcactttggaaggctgaagtggaagaattgctagagtccaggggtttgaaaccagcctgggcaacatagtgagaccctgtttctacaaaaaaataaccaactaaaaattagctgcacacctgtagtaccagctactcagagggctgacgtaagaagattgcatgagcccagatactcagaggactgaggtaagaagattgcatgagcccaggagtttcagtttataacaatctgtagtcatgctactgcactccagcctggatgacagagactttgtctctttaaaaaaaaaaaaaccaacgaaccaaccaaccaactctccctgccctgcacccgccaacacacacatacatcaaaaaccctgaattattcatggaattttctacttaataaatatttttggaccactgctgaccaaagataactgaaaccaaaaaaaagcaaaactaaggataagacatactgctatattttaagaaaatatctatagtcaatagaaatacaaaaatccaatattaaaaatgaggaaaagacacttttagttaaatatgcacctgctatatgctttggaaactccactcctacatgtttgcccaggagaaataaaacatttccacaataagactacacagctttattcacaatagtcccaaactggaaacaatccaactgtccaccaacaggtaaaaaaaaaacactttgcgtattcatataatgcaacactactctataattttttaaaaggcactataaatcaatgcaataacatggatgaatctaaagagtcttcatgcagtacaagtacataagattccattcataagaaattctagagcagacaaaagtaagctacagtgacagtaattaggacagttattgtctgttctaatgggggatggagattcactggaagggaaaacatgggaactctgtgctgatggacatagtctacaccttgactgaaatatggttacataaatgtaatttttaaaaactaacccaattaagccctgggtatttcactgtattcaaattttaccccacacaacatcgacaccaccattattaccaccacattgataacattcagagagcagttagggaatcacattattttgaaaattagtaagtaatgggaaagaattaagcattatcgtatatgatatgtacatatttatatacatgtatacagatcctatatgtggatctgtaatttagggtagtcatagagttgatgagaaagagtttttcttaagaagtattacaggtaataaaggaaggaggaataaagaattcgagtatcacaattttgtaaccctcaatgaattagcagatctaggcaatcagaatccacgataaaaattactagaaaagacagaaagcgagtgagacttttaagttattcctacaaaccaacatctatgaagtatttgggaaggaaataaactctgaatctgtttttcgtttttttgagatggaatctcactctgttgcccaggctggagtgcagtggcacgatctaggctcactgcaacctccgcctcccaggttcaagcgattctcctgcctcagcctcccgaggagctgggattacagctgcctgccaccaaacccagctaatttttgtatttttagtagagacggggtttcccccatgtttgccaggctggtctcaaactcctggcttccggtgatctgcccgcctcgggcgtttttgcatgtattttttcaggtgctgaaaaagctctccctgatttcatttcttgttgactgcttagagacatctttccaaatgtccttccttgtcactttttcaaagttaggagcagggattgcacgtttttttgattggtaatttttgtttcaaaggtttgattcagattcagagttgattttgctaggtatggtggctcacgcctgtaatcccagcactttgggaggccgaggcgggcggatcaccagaggtcaggagtttgagaccagcctggccaacatggcaaaacccttatctctactaaaaatacaaacattagccaggtgtagtggtgtgcacctgtaaccccagctactcaggaggctgaggcaggagaatcacttgaacccaggaagcggaggttgcagtgaactgagactgcgccactgcactccagcctcagtgacagagcaagactgtttaaacaaacaaacaaaaaattaacaaaatcttatttctagtggtttacatattaatgatgctggcaacttttagttgaaatgtattaaacagcctcgcagtttttatttttatgaattctgcatacaataaataaataccaaccaaaatatctatacaggcataccccagagatactgccggttcagtttcagaccatggcaaataaagtgattatggcagtaaagtgagtcacacaaatttttttgtttcccagtgcttataaaagttacgtttacattatactgtagtcaagtgtgtaacagcattgtctaaaaataagtacattatcttaatttaaaatcattgctaaaaatgctaatgaagtgagcacattttgttggaaaaatggtgctggtagacctgcttgatgcagggttgccaccaaaaaaactcagtatctgcaaagtgcaataaagtgagatacgcctgtaatgtcttttttctcttctgttattacaagcactactttaagtcttcaactaccgaatacttgtagactatttaatgaattaatattttcatcatatttatattgagaaaattaagaagctgaatttagttagaaaaggtttagaatatcatcaactcttgaggatgagttggaagctactttatctgtcatttttcacataacactagtttgcccttcaaatcatacatttaaaaatgatcttaagatacataccaagtagggattatgttgttataaaaagctagaagtaaaattaagactttaatttcaaagataatttctctataaagaatagcacaagatatgttcaactattctcagagatgcatcaagatatgactttttttcctactagaaattatatctatgatcaatcatattacagagatattgctgttatactccttgtgactgatgaggggggtttttcctatcaccatgttatcccaaccctttaatgaatcacctttgaaactcagaacaggtagcagcacagaggttgctaagagtaaatacattcaccactgctgccagaaatgaccaacggtgcaccagaaagaagaaatactggtgaattcccacataccacgacgaacaaccttataaaataacagaacaaatgaatataaagtaacatacagccatcccttggtatatgtgacagggattggttccaggaccacgtgtgtataccaaaatccatgcacgctcaagttctgcagttggccctgtgaaactggcatgtatgaaagtcagccctctgtatatgcaggttctgagtcccaccaatactgaatctgctcttagttgagaaaaaaaatctgcatgtcagagggcccatgaagttcacagctgtgttgttcaagggtcaactgtaatataaaaataacatttattgctagatagagttgatattcattctagtgtttatatacttgagtcttagagcaatagcctttggagacaacttccaggaaggtacgtgtttgcatgccttctcactgcaatccatcagtagctgccacttgaaccagtcttagcaggggatggggaagcctatgtctttcagaattggatgatgtagtacacagaagtagacagtagagtagtaagggcatttgcttaaaagcagatagaactgggaacctctacatctttctgtgagaattcagggcttagttttttagggtgtaaaatggaaatactagtatgtatctggacatattatcttaagaattaaataaaagactaccatttcactcaaaaagtgcttgatcctgggaagccatgtaacagttcacaaatgcagagttcaaaagaaaggaaaaattgcagacatggtagccttattttaattatcttctaaccagcagtaagcatactctaaccagtgaggaatactagataatccatacgccaaatgcaggagattacatgagacttatatataacaacacttcattcatgaaataaatcacaagattagctctgaaaaatggtgattatattacaaatacaaatctaagtatatagatgacaatttgtgagtttgcttatttgggaattagtacctagagataaaggtctgaagcaaaatcacacacccctttggtgaatcaaatcttcctctgaagaactaagtacctcacctaatcagaacagagtccctggtatagccaccgtcatattctgtagtttcttctagtgcttggaaatctagattctgcaaattcaagaaaatatgtcttagttatctgctatactactgtatcattacaaacaataaatcgatacatgactttttgcagacacctgctttcttacccggcttccacatataagcaattcaatttcttctggtctgaataagtactttaagggagattcattggtcaccatatgaaaacctctccgaaaagccttgaactgtttttctactgatttattgagaatgtagtcagaataaagattgacaaattcctgtagaaaacattaatcacaagaacttcttataatatgctatgcaaacaaaacacaagttattgggctgcatagctttttaatttttccaagaaaaaaacattcaagaatattcttaaaaattcaattttacacctacttcttaacaatttcacaattctctgttatagccaatattaagctatgaaaaggccatatacataaaactgtcaagaatattcttaaaaattcaattttacacctacaaagaaaactacttcttacaatttcacaattctctgttacagccaatattaagctatgaaaaggccatatacacaaaactgtcatacttataaatgtcaatttcgataatgtattaaacagaactgaatataaatgctggagacgcagaaaattctttaggttctctcaactaggtatgtaaacagacacatttaaaccatgtatccatctatttataaatgccaaccgttttaagagagtacaatatatttgatttaagcaaaccaggaagtcccaagttttctaccatagaatatttggtaagctgcctactgtatccagttcagcaaaaatgtggaagtactgactgacacataaactactgtatcaaatcataaaaggaaaatgtgctttgtacccttagtgtgtataatatttaatcaaaaaattatatcaatataaacatgtttcttaaaggtatactatatatttgtcataattttttgcttgttatgttctgggttattcccattcccgatgaacacattttagtcaatagaaacccaaatctgacgtaaagtatacttttcagaaatgtatttttatcacaaacaggatatacatgtgtaaattaaatgtaatttttatttgttctgtgataaagaccttaatcatgaggttcctgcttacagcttaatacaagaaacaccctgcttcttgctttatactacaaccacacttagctattaactatctcctgcttcatgtcctctttctctaaaaggggctttagtgcccaactgtgtgctttcataccaacttatatccaagatttagaaaagtggactctagcatttacataaacttagttacttgttttttttttgtacagactatattagatacttctttaaaaattataagcatacatgctttgaaagtgttaatgaagagacaaaatgtgacataaaaacatttattaccttcctgttttcatttgtaattggaattttatcaccattttcctttagatcatacatcattgggttaccaaaaagatctgtctgtgatatctggaaagtgatcatcatgtcatcttccacattcccttcatactccaataaatcttttaaactctgatatagaacctagcaaccagaaatggtaaattgaggccaccatagaactacaaaatacaacaaataatttatatcactcttcttagaagacaacaaaaatcttatcaataaaaattgtaaaaagtgtagacagtatccctccagtcccccaaatagtttccaacctataaaagaaagattgtcagtcactgtgatgtcccattctctgctgagaaaccccataccaccaatttagcaatagaattcacactgtgctctatgagaaattctgtggtgtctcaaggtgggggtgggggtggtaggagcaggcacactcgttgtaactaccaagacccttagccagggctactctgatttttacctatctcttaagatttcactaaaacacaaacaaaatgtttagaaacacttctctatgaaatcaatcttacaaaagcttcgtgctgacagcaatatataaaaatgtccccctttgagtttttaagtgtttctggtacttcggtcagattaaaacatttttatcttattgataagagtatcaacaaagattctaaacaaaaactttaaaattttgacataaattaaatttttgcatttaaataaaatctaagagactgaattaaaaaaatgacaaagaacttactgggtgagagtctcccaagtcacgaaaagttccttttttccccattagcttcctgtagacaaccatgggaaaatgtacatccagtatacagttattgtaaatagccagacccagtactatgccaatcagagtaaactgaccctcagtttcaaaagaagatggattaaaccaaaacaattttgtagattcatcgtatgtgaacatacctataagaaatgatttttaaaaatacattacttttgtattttattaaggactgatgaataatacaaatataaacttaaaataattatgcatataaaacatttaaaatatatgtaattaggcatgcaacattgatttctattatattagcacttgagaaaacaatgtccacatatatctgctataaattggggtgaatggtgatatgtaattttatgaagccaaaggaataaagtagtaagtaatttggtggcatcgggtagaaaaatacgttaattaaattcaagctttctaattttctactaacacataagaaaagttatattcatgctttatccacccatagctgaaaaataaacataaaaaaacaaaaaatggctacatttccaaagtgtttcatttataaaaatataattacttatatctgtaccacacgtactatttttgaaaacaatttttcatttttttccttgagatggagtctcgctctgttacccagggtgggctggagtggcacgatctcagctcactgcaacctctgcctcctaggttcaaacaattctcctgcctcagcctcctgagtagctaggactacaggtgtgcaccaccacgccagctaatttttgtatttttagtagagaaggggtttcaccatgtttgccaggatggtctcaacctcttgacctcgtgatctgccagcctcagcctcccaaagtgctgggattacaggcgtgagccaccacacctggcctaaaaaacaatttttaatcacagtaaagaaaggttcgttttttcaaaattagacaatggtgccatgaaatttttctagcattttcctaataaaatcagatgatctgaaatacataaacctggataaatctgatgaacttagataaacaaagctattcaatacacatgttaattatgggccaatacgtaaaagaaaagtagtttcgtagtctttcaatttcacatggtcttcactatgcaagccccaatcatggaggcttttttttttttttttttttttgagacggtctcgctctgtcgcccaagctggagtgcagcagcactcagcttagtgcaagctccgcctcccgggttcatgccattctctggcctcagcctccggagtagttgggactacaggcgcctgcgtggaggccttttttatatcactcattggaaaattggggcccggtgtggtagttcacacctgtaatcccagcactttggggaggctgaggcaggcagatcacttgagctcaggagttcaagaccagcctgggcaagatggagaaaccccatctctacaaaaacacaaaaaataagctgggtgtggtagcatgtgcctatagtctcagctacttgagagggtgatgcatggggatggtttgagtcttcagcctgggaggtggaggttgcagtgagccgagacagaaccactacactccagcctgggcctcagagccagatcctgcctccctccaccaaaaaataaaagattaaaaaaaaggaaaattggaatctttggaatgagtactactaaaaattgatttcttcccttttaaatgactaaggaaaaaaattttaattgaatttaaatcattttactacatgtttagttgctactgtgaaacaatgaaaacatcttaagaattaagtctgaaaaaaatctgtaatttccaatagaaaagtagagcttagaaatcagaaatcaaattatacagtatataagtattttaacctgtttataagaattttaaaatctttgaaaatgtcattgtcactttaagtttaaaaataaggagctttaacatgtttccttgatcactaggagtatgaattaagcttaggacattttctgaatgcaaaatggtttgaaaattaaacaattcatatttgagtttcatggtttctatctaaacattttttttacaggccaagttacaacatccatggaaatgcttttagttataagtatggtattaacaggatcaagaacagctgacaaataattacaattaataaatttgttcaagctgacaatggtgtgtctaaaaaattaatgaatttaataaaatgtcacaaatgcccttccttggaaccaagagcaacaagctataagttaatcagaatataactctgaagttccattttaggcacattttctcatgttccagggagaaaagcaccataacctcctggtaaaatactcctttttgatacttctactgccatcacttcagttatcttactggaactgcttaatctatgttttttcttacaagtatttctgcatataatgcaagtatgctttatagctaaggtttaacatttctagatacatcaaaagctagagctaaggtttaccaaatttaagaactttatgaagtttataattttctatctcaaaaagggcgtcgtcttatgtatctctgatttacttagaacaaactacatacaaatggcatagctttttagttattaataaaacactagctagattatagataagggatgcgtgtgtgtgtgtgtgtgtgtgtgtgtgtgtgtgtgtgtgtgtgtgactaagaacagtaacagaaaggtcaactcaattagaatcaacaggctataacagctcaaatctcaaagctgaagggaaatgacatacattattctatgcacactcctcacaattctgatggtaccttcagtggaaaccttttcctgtaattgtcatgtactcaattttaaacgtaagcaagctcagttactaagtggttatatttacagtagaaactgaaccagttcagaattatgaagttaagtagactacccaaaagactgcatcttttccctgttctactttatcacaaaagggaaaaaactaaaattctgatccttcactttcaaatttccaaatcccatcagcctttcccaaactgtgttcaataacaactcttctgttagggcagaaaaagagttctggagttcaaaaagtttgggggaaacactacctatattaagccccaagaaatcttatagcaaataaacctaattaatgtgatatcagctagtgtttctgaactttgagcatgacatacttgtgagacagtctctcaatactcttcaaaccattgttctttgaagttcacaggtcaggaaaaccgtgagtttgatgatggttttagacaacaaaaagcaaagaaatccctccaactgttccaatataccattctaaagtgctttcaattcagtttaccaaagagataatttccttcattagaatattccttctaagaaataaaagaatttgaataaattagtgatacaaatcagttcctaaaacctacaaattcagtcatgatgtgtgattctgggtaatccataccaaatccttcttttgctgctcttcatagctgaaaatatttacaaagtaagataaacaaataactaactcaaaagatgatacgacaccataatcacattactaatgtatttaccaatatctggattgaagatttcctccacaaccagctgaaaaaattctttggaaacacctccctcatcaactccttgttctccttcaaattccacatacaactgcttcttcaagtctgcaggattttccatagcgatcatctctagctagtgattgaaaagataaacatgaaaagaagatgattgctagtatcaggaaaaaaacaaaataaaaacaaggagtaggattaggaaacaaatacaaatttttgactttttgtatgtaaatggaaacagaaagcaaactgataaaaagccagtgaagacaaagattcagtcttaaagataatcaaaaagacagacacaaaacagacactagcatagtaaaaagctaactttactgatttgttatgaaattaacatacaattaattaagattttattacttgtgtgttaagtctggactacacaggacatggaaaagcagctaaatcatttcagcaaaaacaatggagtagaggtctaacctcaaaattgttcattagtagtcctttattagaatagaaactcaagggttaagtcttagtatctactaagtcataagtaaaatatttcaattaagaaaaatacactgaatactaaagcagtttatggtctctcacagtaagacttagtataaattaccaccttttaatggactagaacccatcttatatccacatttccttaaaaacaggtgagacataaccttactcatgtccttactctttttttttttttttttgacatgaaatctcactctgtcgcctaggctggagtgcagtggcgcgatctcagctcactgcaacctccgcctcctgggttcaagcaattctcctgcctcagcctcctgagtagctgggattacaggcaggcgccactacgcctggctaaattttttatttttagtagagatggggtttcactacgtttgccaggatggtcttgaactcctgacctcatgatccgcccacctcagcctctcaaagtgctgggattacaggcgtgagcaactgcacccagcccttattcttaaattgtaagttaacaaactttagtgtctagcattttctcaactataaatcttttaccaaatatttttgtgtacctatagaattatgaatatacagtaacctcattgagattaatcataaaatcaacactagattccaatattaactgtttatactgcattttgtttgttttactttatgtatctaaaatttgctaacagtatgactgtatccagtacatggatggatactgtatctagtacatggatggatactgtatccagtatccatcatatctcctaacttgccttcaaacatctgttggctggttaaaaaaatttaatcttggagatgaaaatttaccaaaacaggatattaaatgttttcaggttattccaactatttcaaacagaattttaaaaatggttttgaaaaatgcaataatcactgaaacaactgtaacacagcactatagtagttaaagtaataatactcatttggacaatctagtctgtctacaaaaaataaaatctcataaattaacgcatcaggtcaggttgcccgagagcattgttttttcaaacttgtcacctgcaactcattagtgggtagtctaatccatttagtggtttgcaatcagcaatgggaaaatcagaatgcattccacatagtaatggaacctactgttttgtgaaacttttgtttcaattagatgtacagatggataagcatgtactgggatgctatgtaaaatactagggattgcagtcaaagagtttgacaaaactagctgaaattatcttctgggtatcttcaactttagggtcctattctgtgaatttagtctttagctttaaataatgtctgttgttgttcaacaccgatctctaatatttacaaaatcatttttaggccacacagtttacttttagacaatgttttgttatggaaagaccaagagtcagtcagaattcaccttactagtcccaactctcacttaccataacttttaacctttaaactttagcacgcgattcaattaagcctcagtttcctcaacatactgtaagttgtgaaggcttattaagaatatatgagaacgagtgttaccttttaaaatagttttgctctctgaacaacagatttgcaattttgtgtccccaaaggaacttgatatagactagttccaagatctagagtcaaacaaatgtagatgtgaaaataaccttggggaaaaaaatagtttcagttggaaacctgtttcaagctacggagtatacagaattctgaggagactaaaattagaattaacatcttagctcaaatgtgggaccaggccaacattccatattgccatgtaatccattctgagtttccttatgccagttcccaactggctaggtgttaaagatgtaagtcagtgtttatatttacctttacatccaaaggtatacttgcttttatcaaatataatgtattccaaagtggggaaaaaaaaggttatctggtatttagactgtgcattctacagcttttccccactaacattcatagatgagagctgactccttatcaatgtaaaaccttttaaaggatgtggtggtgaatttctacaggattgagaggccctgtgttctatctagtcttagctctacctaagacatgtcaaatgataactgaagcaaatttatctttattctccataaaatattacatgtctgtccacttccactgatctctattctatgctccccaccttggtgccaaaagaatgtaatgcaatgcaatatgttctattgtaaatgcaaacatacaactttacctctcttatttcatctgtaaaataaccataataatatagtaataaattaatgtatgaactgcttagattaattccctgcataaagttagtgcttaaaagtactagctgttgttgctgttattttattggttctaaaatattttctgaaaacctaccatagcattatagaacaaaaatattccatgaatacagcaacaataatatatagcacttttgtagcatttcacacatagcaactaatttaatcttcacaacacccttatgaggaaggaaacattaactccactttacagataaggaccccaagatactgaaaggtgaaataacttcaagtcacagtaagtcacagtaagttgtggaacagagatactaatccaggaaacaagctcttaactactatgctttactcactctcttcaatgacgaccaaaaattttttttttaggattatgagtgatttttattttccttattcttttccatatttttccattttttacaacaaatacatttttcagagtcagaatgtgttcaaatataaatatgtaaaaagaataatttgaaaagtagttggtaactgaattctgtaggcaaaaattttgttattacctattttagattaccattctggtacacataagtgatttcataaaatactgtaccacttaagaataaaggctgggcgccgtggctcacacctgtaatcccaccactttgggaggccaatgcaggcagattgcctgagcccagcagtttgagatcagcctgggcaacatgatgaaaccttgtttctacaaaaaactaataaataaataaataaataaataaataaataaataaaaaatagtggggggtggtggcatgcgcctgtcatcccagctacttgggaggctgaggtgggaggtcaaggctgcagtcagtagagatcgtgccactgtactccaggcctgggtgacagagttaagaccctgtctcaaaaattaaaataaataaaatagtaaaaacagaatacataaatagcctttaaaactattttattttaaattattaacacataaaatttagcaataaccattttgataaaggccattattgcataaacagctgtactgataattctttttcttaaaaataacctccatcaattgttcggtcaatttaaaaaagatttaacaaataaactgtaaaggtgtattctttacataatagctatattatttaaaattgtatgttgttgtttaaacccaaacctcaccataaaactgtattttttaagtcagaagttgttttaaatgcattaggatatttgaaatttggaggactatgtctaaacattctgaaaaggagaacgtgcatgcatgcctgaatttatttacaatacacacgtggatttttagggttttttttgtttgttttttttttttttttgagacggagtctcgctctgtcgcccaggctggagtgcagtggcgcaatcttggcgcactgcaagccccgcctcccaggttcatgccattctcctgcctcagcctcccgagtagctgggactacaggcgcctgccaccgcgcctggctatttttttttgtattttttagtagagatggggtttcactgtgttagccaggatggtttcggtctcctgaccttgtgatctgcccgccttggcctcccaaagtgctgggattacaggtgtgagccaccgcgccaggccaatttttaggtatatttaaaagtacagtgtatgttgtatttatttaacatggagactagcaacagacagagattactggggaaaaataaacaaaaatatcctggatataatcatatctacctcttcactgcgtaacttcctcttctttaagactcttgatttcatcaattgctggataaaatgatttttaatttctgaactttttaattggccatgatgatgaaatcctagggagttcattttttaaaaaaaaaatctgacctgatatcaaagcatttgcagaatacctagcaggatgacatcttaatatcaaaatatgatattactagacttacaggaatcaaaaggaaaaccttatcacttaaaatcttatagttttctgagctattacatcaaatcaattcataattttttaaaaaaattccttaataccatgaatatttaagtagaagcaataatcagataaaagagacctctaatacttaagaatgcctgggatttctaagaaaggctagcttcaaggccgggcgtggtggctcatgcctgtaatcccggcactctgggaggccgaggcgggcggatcacgaggtcaggagattgagaccatcctggctaacacggtgaaccccatctctactaaaaatacaaaaaaattagctgggcatggtggcaggcgcctgtagtcccagctactcgggaggctgaggcaggagaatggcatgaacctgggaggcggggcttgcagtgagccaagattgcgccactgcactccagcctgggtgacagagcaagactccgtctaaaaaaaaaaaaaaaaaaagaggaaaaagaaagaaaggctagcttcaactacttcagtcaacttgaggcttaaactattgcttgagatttccagattatccaaattaattttttcatgttcacgataaacacatgaagaaaagtctgttatatctcaaatgtagtttaaatgtttgggtaacaccaaatcacataatcacgttcgtccatgagacctggaatcctgacttctatttccaattctgccattaatttatgtaggctggaatctcttttagatttcattttcctcacatgtaatactaagtttgatgtttcattgtcttaaattattatataatgctgaggatctatgtatatataggcttcattctctcattcagtttctgagaaattactttgagggcataaaccaagcatatttcttggtttcatttttgatttcaattagaataaatcacaagaaagaacaatggaaattacatgttaaccacaatatagtgtatgtgtaagacaaaattaaacatacctagtgcagcacagaataatctcatttttaaagctctgtgagtcaatgaataaataaaagaattacgttcatgtttcactagtaagagtgttcaccaatgctggaagctgggagctgaaaatgctggaagctgggttagactaggctattagaaaccagataaaaagggccagtgacttttagaggggattttgcagaacctcctggtagtggggctttttatctgtgccaatcacctttatctgtgctaattcctatttttgaacttccctattcaattccacatctcagccattccttttggtttttagatatttatgtgaaatgctagaactccctgactaattggaaccaagtttcacatcatcatcatcctctattccaagcttgctgtccccatgatcctcttaaaaatctgagtttccaaaacacataaacatacttgtatatcaaaatggcctttctctttctctctatatatgcacacatacacacataaacacacatgcacacacacccccacctgagctgaaccaaaggccatcttcccaaatattggagtctggctttatcaaaatatttgtggagtattaccagaagttcagattcataggctctacaatacagcttctaatctaaacctctagaggttagggccctggattttatttatttatttatttattttttttaaacaattttcccattcagatgtgaaggcagtttgagggacctcatgatggcaatactatattcttccataaacttataacctctatcttctcctttaagaagtaatttaaaaaatcttaatacatactatcattggaagtgcttcatctaagaaaaatgagaaattatctacttgtaaaagaacacacaaatgggtatatttacatatttgtaaatatgtaaatatttacatatttgtaaatatgtaaatatttacatatttgtaaatatgtaaatatttgcatatttgtaaatatgtaaatatttacatatttaaattaaattaatttacatattaaattaaattacatatttatattaaaaatgtaaatttgtaaatatggttttacatatttgtaaaaacctcatcacattaggaatgtcattcaaatgaaaggtgaagtctaagctcatgtttatcactgtactgttttctaaggaacaataacgaaaaaatactgaaaataagtcctaggggaactatggcagtaagttaaacgggtagggtgggggtgttcttaagcagttctaaggtatttgtgaagagacaacttatattctattgattctaaaattcacttttttcacattatctctgaaatcagattacaccatacaaatgatagcatcttacaatgaattgctggtatttttctgtcttagcagtaataaaatgatagtgtttcctacaatcagagattagtgaaaatactatcaacatgaattcttctcttgtcatcaaagacaatttctctaaaaacctcaggaaaaaagctgctagtctggtttgaatttcacaatatataaaagcaatgaatatatttttcttttttaaaaaaatccacaattattaattcaagttaccactcctcaacagaaaacatacaagagtctcatatatgaagtcactattttctgggcttgatttctaaactaaggagtggataactctaaggtttcttttagctcttaaagcctaggatcccataattttatttatcaatattaagcttaccacaaagtttctcatttcttcttttccacccaaccctgctatacaattccaaaattagcaagtcataaaaaagtggccactagtttgttcactgtgatatataagaatgaggcttaaaaagcagagatccttgggaaataagatcttgaaaaattcatcacttttgagctttcatatgagagaataatcttaaaccactttctattatagaacttctactatgtgttactaaaatatgtggctttatcataatcatcacctgctgtgaatacttacttcaaaaaattacacaggttatcaattttacttataagacctatttcgatgctggtttttctagtcttttcacattctgttatttttttaaaaaaaagaaaaggaagaaaaagcaagggagaaagaaagttaagagtaaaatctgcttagtgtgagcattcagagcccctaaggaagcttctctgtaagcatcatctctttctattttcacagtttattaaactgcctaacacacatgatttctgaagtgaactgcttttgtgggctggcaatattcaagtacatatactatctagtgaatcctgatttatgataggccacactatattatctaattttgatataattaagcagaacttgctaaaaacaagttaccataattaaagagctcacagttaattttacactaacacctaaggctttaaaagcagttgtttccttaaaattctagaatagaatttaaaatatagaataaagtatataccaagtacttaaacttttgtttttagtcttgctttactagagaaaaaaatgggggactgaggaaaataagactgagtagacttctgagcgaaagacagataaggaaggtagacaattttttgaaccctggaatgattcttacagtgtaatttcattgccttttaaaggctagacatagcttttgatgaagacagctgaagggatctcacctcaagaagccaaacataaagtatgtagctttggcatttgcagttctgctccaacaatggatagtcatagacagacctcaacatacctttcataaaacatcactcacattcttataaaataccctatcattctgctaaactatgtaaagtaaggtgctggctgccttatgatcagtcattaagtgtattaattattcatgtgtctcaaaactatgtaagtgaaataaaaagggtaccagaaagcaagcaataataatgacttcaggcagttaaagcccccttttgtctctgctagaaaaccacctgagttgcttaaataatgcagaatctttctccaacactataaacatatctgacattaaaaaaaaaaaacaaaccagtaacaaaaaaaaaaaaaacacacaaaatctctgcaatttttaatttctgagatgtcaaataactttttccaccgggctacagctttatgaattctcgaatttagacaattctaaaactaaaatttagacattctaaaactaaaatacattttaaagtaaaaatcacatttcctagttgtctgtgtcagacaactttactagtatactatagtattattaactaccttaatttttgttgacattaaattttacttgaagatgataaaaaagtagcagcaatgacagggatagctaatactagaaatacaataaagctctgcgataatgcacctgagacaaatgtaaattttggtgaaatgtgactgacgactgctttctgtcttctggccactcttatattcttaaacagatacactaaaattatcttgtggaggaaagaaaaggaacaaatggcaaccccatctggaaaaccaggaagttaggatgagtacctgagtttccagtatttccctgctcaatctccctggacttgatgttacaggcaccactaatccccagatttttggaatagctgctgttttccagaagttccaagacccagagttgtctctatgaatttttaagtgggaagaaactaccacagccaggcagtgccgtccacacagggatattctaagtggcccagcaggactcaactcttactggcaacaggcactgatctgccatggtcacttcatcaagtccacaataatgcaactctgaattttacacgatggaattttttggacactacctataattttatggtatggttttactgtaccattactcccagttcaagactgcacatccacacttattattgggtatctccacatttctcttgttctggtctttgtccaacactctattctcttctgaatgaaagaaactttggatttagttttcaagatttagaaaacccattctttttcaaagatagcatgaccattatataatacaaccgatactttgtagaacacatctataaacttgcacaggaacaacaaaagtataatacttatataagatcagaaatgtccatgtgttcctatgctatatggtatcatttttttcagtcacttttaaaatgaattcactgaactgtatcatgatatccccattattaggtttttaatctagcagcccaacttacccggacaagtgcatcatctatgatatggtcacgtctaactttgagtctcaaatatggattcaactgctgtccttgaactaagctgtagagaacagtgattcttcgttcactgtacatgcgaattctattgtcataatataatcccaaattctttgtgacagcattcaatataaagggacatgtcataaaagagaatttgttctctgtttctactttgaaaaaagtataatctttatccatttctagaacctcattcagtggttcattaataaactcttcaaaagggataagtggttttcgacaatccagggttttaacaccaagttcagtttccagggggtccactcgaggacctttcttgtttcttctttcttctcccaaaagttcctgaagtgtcagctcgctggactcagggatgggctcttcatcatcttcttcattgtgatttgtgtccacttcccctcccactacatttgcatagtaaaccattttcaagcacttcgaagcagcaacaatggcatcatcatcattcactagatttcgactgttaaattcattgcttatgactttataagtaataagttgctgaaatgtctccatcattctccgaatctggtctgcattgtatttagaccacagtctgatcagttttccttgggctgcaaggggtagcttgctcatcgctttgcaaaataatggcaaagccatttccagatattcaggactgtggagatttctattctccattacgataatgaacaaattcagataattaggatctcgagagtatacattgtgatacgtcaagtcacattccacgttaggtgacaaatatacaagtgcattgagaaaggcagtttcaattttttcattagagagcaatctggtgtagacccttctaatggcatcaatatccacagacacatcatcagggcctaatttttgcaaattgttgtctccctgtgagctatcacctatccttgaggaagatgcttctgagtcttcttccatagcagcagcagaacatgcagctttttccttttcatcttcatctttgtcttcatcttttgcttgaagagatttcagttcttccttggtgtgttgtttaactttccggaagctctgtaccaatgcctcagcactagaaaaaactcttccaataacacggattaaaggggaataatcctctctttctctacataattcaagaatttcatataccttctcttctgttaagtaagtcacatctagaaaatcagaggaaaaaagagaacatttattttcataatatgtatgtttactctgttgcaaaaagttctaaaagtaaaacagccaaacattctaggctcaatatcatttatgatatacaactcttaaagtatctaatacttagattcagcaaacaaaatttaatgcttacctatttttttcaatgaactacctacctataccaatgacctcacccatgcttttacattctttcaacaatgtataactcttaataagatcatgagtttaaactttctttataatcaagatatctattaatgtatagctttaattataaatatgaaccaatatgtcatgtactgattaatcataatacagctcttaaaacctcactgtagaacacacagaaatactactaatctgtgagttttcttgtttcagtactctgttctccaaagactaagaaggcaaggtcttaaaaaaaggctccttcagcatctatgtatgtattaaaatcaaactggttcattttgggtcttcctagtttgttccagggtagtcattctgtgagtgattgagaagaatataccatttctcatcggctcttaagtagaaactgctttccacagccaggaatcaggttagactaaatctcatagagtgacagaaaatagtttttgagcaatgaaaacaaacagtgcaaagaagtaaacttatgagctggcaagcagtgcagagactatgtagtcatcaaaatctatttcctcttttcctgggcacagagttggaccacatttcccaactttttgagataagtgttattttcaggccaaggctttctcccttctggctaataggatgaaagatatttcatttcacaggtaaaaacaaatgatatattttgtgtactgaccaacataatactgagaatagtcttaattctcccttttatcaataaagtgacatacttgtcatcatcagattaactacttgagaggttaattttagaggcacacagacaatcctacctccattgcgccaaatatacccttatacatgtagtgtacaacatgtagaatttttaatgactcccacctctgctataatatatgtttcacaatgaaagacaatataaaatgtaagtgatcattgaatggtctccaaaaattgaagcacaaaaataccaaattttatcatactaaggatctgatctgtggcccagctacaagagtaccaacacttacagtttcttttatgggccttaactctttaagaactaattctcaggtttgttctattaagaatatataagcatcttttgctaaacatcagtaacctcttccccaaaagcataaaaccactggaaacctatttctcattattttcattgaaaatttttaaaataccttcttacaagacaatgcaaaactcctaatttcctaaaatgtaacataacagaaaatactactatcctattaggacatgaaacactttgcttcctgagcaagtcataaggttaacaaagacttgctttgcatgcagtaatatggcctgtcctagggatcaccattctagactcacatgtcctttgttgatatgtcatgctttcggaacatcttcaagtgattctgacagtctactaatcctatatagaatgtacctatactttttccaaggagtgttttttgttgttgttttttgacatggagtctcactctgttgccaggttggaatgcagtggcaccatttcggctcactgcaacttctgcctcccgggttcaaacgattctcctacctcagcctcccaagtagctgggactacagatgcacgccaccacaactggctaatttttttgtatttttagtagagagggggtttcaccacgttggccaggttggtctcgatctcttgacgtcgtgattcgcccgcctcagcctcccaaagtgctgggattacaggcgtgagccactgtgcctggcctgtagtgtttaatatgttaaactgaatttttcaggtatatagataaaaattagtcaaaaaacactgtaattagatatgaacattcaaaaagtttggtttattgatacaggtgttctactgagaaagacatttttataagatttcttgtgataaatgtgtccctgaaaatactcaatcttttaaattttgcacttaaaaacctcctacgcaaaaacagtttggtgcagactacttaatacttatgcaactttgtaattagtgttaacaaacataattaataatcaaaataagagtactagtgtacagaaagcatctctaatttccaatatacaatagtaactatagaacaatgcaaaaacaaaaacaaaaaaaccagtaacgaacagggaacagtaacagtagcatattagaaaacagggataaggaaaggtcacaactgctataatgcagacttgagcaaaaagaggagggggcataaagactggataaagccacacaataagcacctctaagatggagcacgtggccaaaagagcagatgagcacattcctcatgtaccacatcccccgcagctggctgcattccactgtgccagcactctacattcagttactggtactctctggtgcacacttactggagaactgtgtacaataaagtcaatgcagcttccacattatactgacacactatatatacagacaacatttacctattttcccatagtgtgtgaactaattcatgaaacagaattatacactctgaagcaacaaagttgtgtaaagtgacgaaaataattttattgtggaaacagagtagaggttataacacaatgccacttcactaattctttcaaacttgattcaaatgatgttagtgaaagttttagaggcaaatgcctctaaaattctctgacttgtatgtcataaaaaaaaagctttctctcttaaaatacaattgcctctgggtgtgtgtaggggtgagagtggaggggcgctaagccctggtagtcattcaaaaatttgattactttgttactaattaccttcactgaagaaaataacttggagttttagtattagcgacaaggtaatcgaattctgaattttggacgtaggaccatttagaaaacaaaagacctgagtgaagactgtcattggtaggtcatgatccttggcagcatgactgtaccaaatgtccggaaggagagtgagaagcatatatctgaaggaaacgtagaattctcacataactatcacaaaattttgtcttgccttcaaaaatggaaaaaacccactgtttcctctttctgcttctttcatcacatcatcctgaggttccagaactcatgccagatacttagtccagttattctataacttaaatagatgttgtggcctagttttggagattcactaccacttaatacatttttcctaagaattttaaaaagttcaaatcaatctattaacaaatgaacttttggcatatgatctgcttctaattagcaatgattagacctgtaaaatgtagttattattcctgtccgttaccacaataaaaaattggttctacgatatcaaaatgtctttatgtcacagaagaaaaaacaaataaaaactaatacatttaaatctcccacatggttttcaggcaacaattctcaattgaaaataaaacatcttacctttaaaatcaattctagcgcctttcttgttcatttttatctcagagcaggagttgttgggggcacctttcgagttctcaaggtaagctgagcttgctcctttcttggagggatgaggatcacagagttttgcattaatcttataaagctcgagggctttaatagctgctgcattattatccatacgaagaaaagttggacaggaagcacaaaactcattcgtgcaggcttcatttccacagccctcagttaactggtggtagtagcgttctattagatgctttgcagctgctcgcttcctgtaccaaacattcaaacaataagcacagtgattagtacagctctcaagtacaaagctcaacatatcatcaaggcaaaagttagtcaagcactgaagtgattaacctgtgtatgaagatgagaagtagaaaatggagatgcactatttaccacaactcctgactagtgaaatagttaataaatattttctaggatattatgataaagaatgtcaatgcttactgactgtattaacagagtatacattcctttggtttaaaaggggggaggggggcttgtctgatggtatatgtgcttaagttgtttagtacaacagctgaaaaatcacaaggtttacagctaagagttgtaggattctatcattttaaaaattagcattaggaaaatgagtctatttaaagcatcaatccggttttcttttacataatcagtatttcatttttaacagcttgtaaacatttgacttatagttaacacagaatatctatctggaataaaaactatttttcccaattatcaacaacatgggagacttaaaaataaatttgtaagtggaatatccaaagatagtgttacactgaaagaaagcggctgcagcctgagtgaggcagatcatgactgtaatcaatcccataactgtgggaggctgaggcaggccgactacttgagcccaggaggtcaacaccagcctgggcaacatagtgaggctactctctacaaacttttttaaaaaaaattagccaagtgtggtggcatgcacctgtagtcccagctacttgggaggctgaggatcacttgagcctgagagtcaaggctgccataagctgaaattgcaccactgcactccagcctgggcaacagagctagactttgtctcaaaaacaaacaaacaaacaaaaaccaaaaagaaaaagaaaaagaggctccaaagtgtagaatcttaaatctaaaacttgtcactaaacctcctcattagttccacgtcacaagatggaatattttaagttccatcacgtgaaatcttatattccttttactctgtcaacttaaagtacacagattaatgtcctattatggctgtttcaggagagctaccaaaactgagggaggaattatgtgaccatgtaagaagttagatgacattatattcaacactaaagagtctatgcttctactaactgataaaattaccataatttcagtagaataaactactggatccaaagaaacataagtcatagccattccttttggtcccaaattcacaagcatggaaataacaactacaaagaatcaaaattataagaaaaatagttcagctgattttcaaaacattcacagaattatctaacatgtaggactagatgaccaatgccagagtttacatcttgctaatcatgagaaactcaacaattaacaaggcagcaagtaagtgaagaaacacacgagatccaattttgtctcaacagaagaactttcactctctgtccaggtaggtgacaaaaagtgataattcacacacattcaattcattctggtgcttatttttcaaatgttccatgcaaatttaccactcactgcatgcaaacagagaaaaaagaaaacccacaaagcacatgtaaaaattgcataaacatgacttaaagacattttgctatctatgaagctataaaccccacctgaaaattaaaaactgttatcacagatttagcactatgcaaaatatgaaagtgaaaacatgtaaaaataaaatggaaatgcagaatctagaaaatttaaaatatatattgctacccttcagtaaagaaagggagataatgtcatgttctcccaaactacagtgacttccctggtgaaaatgtaagtaggtatttcctttctggaggaaaacagtgaacatgtatcgaaagtcttaaaaacacgaataccgtgtgaatgagatcctacttgtggaaaataatttgacaattttacaaaaatgcattgtttctatatctgaaaaaaacatgtctaataaaagattacttaaatgaactgataataggtcacacaataaaataaaaactatcaagatttgaattcgacaaagaactgcctagtcttcctgatatatcactaactgacaaaagtcagttaaaaagtagcaggtgtaggatgaacccattgttatttcaaagcattaatagcattttctctggatgatgtgattaagtgagttttaaaacttcttccatcttttgatttcttatttattctttccatagtaaggatgctacttgcatattaaaaattaataactataaggggaaaacaatagcagttataaaacttcatatacatgatttgaatggccccgagatttactaaattgtctctgatttttaaaaaaattacaaaagtcaaaataccaaaatagatatttttaatgtgagcttttatactaaaataacctccccaaaacttgtcagatacatagtacttctttatatactacataggaggagagtgatcagcacaaacagaacgagactgaaaaatcagaagatctgcattaagtgtcatccttctgtccctaagcagctgtaggatcctagggaaacaattgtctgggcctcagttttcccagctttatgagtcccttcagttctaattttaaagttattttatgtaatagggaggtgagcaagaaactagtatttgctggatgcctgataacttattacacacactgcggggcactttgacatgggttatctcatttgaataccatgacattgaggattatcttcagtccacagccaaagagagaaatagaactggagtcaaatcacgaaaccaagatctcaaagaaagtacagaaccaagacaagaataggagtccaggagtctttcagcttcagagtctaagtcattttgactatattgttttgcagaaggtgattcatttcaaaataattattttttaacatgagtaatactgaagaattctatggaaaaaaatctcataactaatgtgcaactgggaaaaaaatctgaagaatcataacgtgaacctcacatttatgcatctatctggtaccacaaaggcagaccaagtttcttgaggaaatggaaccactatattctgcaaagttaatttctctctaatttgttgaggacctatgtgctatgcattttatagacattcccactttagaggggaataaaccttaacagttaagagctcgcattctgaggccagatgcccaagttcacataatggctctacctcttaattaactatgtgaccctgaatgaattacttgatctttctggacgtaagtttcctcgtaatttaaatggtagtatctacgagcattatcatggtgagagtattattcttcttcacattaccaattgtgagaaaattaaatgtgttaatatatataaagtgcttagaacattgcctggcacatactaagcactatgaaagtgttagctactactattattgttgtaattgttactatcaccctcacaagtgtatgagttagcactataaaccttcattctgctgatgctcagagaaattacataagtcatacatctaataagagatttgaactcagctactaaacttgagcttttaataactattaagaggaggatctgaaagtagccctctatatttgatctgcctttctgtgccaagtttaacaaatagcagctacactgatgagacaggactaaaggaagccatgccagaacctccaagttaatggtggaatcaactatattaagcattcttcttttttcctcactccaatgacaccttaatttatctgacctcatctgcatcactatctaatttaggatatgtaaaaggcatacaaaatttagagcacataaaagggcctctacgttggaaaagtatacactaataacgactttttggtatagttcctgcgcaagggaaatccttgtaccatatgggtcaccaaatcatagctcgtaagtcaaatcgagtccaccacctgtttatgtctctcaagcttagaatattttacatttttaaatggctggaaaaagtttgaaaaataataatagtttgtaacgtgaaaattataagaaattcaagttccagtatccatcaagtgtactggaacatacccaagttcattgatttataaatatactatatatgataatgctttggctctgtgtccccacccaaatctcatcttgaattgtactcccataattctcatgtgttgtaggagtgaccccctgggagataatctgaatcatgggggcagtttcccacatgctgttcttgtggtagtaagtctcacgagatctgatggttttatcaggggtttccgcttttgcatccttctcattttctcttgtcactgccatgcaagaagtgtctttcacctttcgccatgattctgaagccttcccagccatgtggaagtgtaagtccaattaaacttcttttttttttcccagtctcaggtacgtctttatcagcagcgtgaaaaaggactaatacaatatactatatagtttatggctgtttttcatactacaatggcagagttgagtactttaggcctgcaaaacctaaaacaaataccacctgccctttacagaaaatgtttgccaacccttagtttaggatctattatttatctctgccctccagtgaccctgccatctaatcatttggcctcttaactctctctttaccctgagcaaatccgtaaaataaaaggtatacctttccccaagtactattaaagaaaagaagaggagaggggaaaagggaaaaaggggaaaagaaagtgaggaaagggagaggatgcaaaagaaaaagaaggaaagaaaggaatttccctgatgagatcccttagtaataccttatcagctgttcataatcaaaattcctagaagaggaacaacagcttacttgctataatttcttcacattccattgacttttcttattactcaaaaaacaaagtatgttataatgtgttgatttttaaaataaaacaaacttttcttatttagtcagcaatgaaggtcaagtgagaccttctagtaaaagtcctctaaagtcagacacatgaaaatacttatccatttaaaacagacaatactttccaattatttatttctatgattgaattaatgggacagtgctacaaacagaagtcctatggaataagtcatacttggaagatcagagtttactctagacaacttgacagcaatcagtttaaaaatggtttcacctagagggatgtgtactaatgttagcaattaactttgaaaggcataaaaattaagatggattgatggatacaaggatggttatacgataaagcaatgtaagtattaatggcagaatctaggtggcaggcatatgtgtgtcagctgtaaaatttgtgttcaatgtttttttagttcccacatatcagtgagaacatgtgatatctgtctttccgtgtctggcttagttcactaaaaaaatgaatttacaagacaactggaatataagcaatgaatacaagcactaagaagatgaagccatagaaacagctgccagaaagtgaagatgtgacagtgaacgccaaacaagtaagattagaattacaattagaatcagaaatgacaaaaaagaaacatgaactgtgagatgcaatataaaaactaatggtgaacaaagcaaagaataaaaaataaaaacggaaagattaaaaggaaaatgtgactgtaagtagagtgacctttatattatacagaaggtaaagcagaatgaacatgtgaggaatctaaaaaacagatataaaatagaaacaactgaaggcttatataattagtctataaagctaggaaccactgcttagtaatttctcgtaagtggagtctctttgttctgagacgttgcaaaactccattccatctcaaagttatttttaatgttaaaatttgtaagagtgagcaacggtatcctaaatagttctaggccttgtagaaatagactgtaagagacatctgtgacacaactatattcagtatgatgtagggtctgttacaatgggatgaagtgaatttagattatttcaagactaaacctacaattgtgaactcattagtaccatgaaccgaacaaaaacctattaaatatagaacaagacgattttcatgaaaaaataaatatgaacaaatcagtattttcagttgtttgaaatataggttaaccttcaattactgttttatggccgggtgcagtggctcacgccacgcctctaatcccagcactttgggaggccgaggcaggcggatcatgaggtcaggagatcgagaccatcctggctaacatggtgaaactacgtccctactaaaaatacaaaaaaaaattagctgggcgccgtggtgggcgcctatagtcccagctacttgggaggctgatgcagaagaatggcatgaacccgggaggcggagcttgcagtgagccgagacagagccactgcactgtggcctgggcaaaagagcgagactctgtctcaaaaaaaaaaaagaaaagaaaagaactgtttttttcatttttatagtctcaatatccagaatgcgtgatatatgataaaaaaaaaagtaaaattgtagaactaaatatttacataattcatctgtaaaatgaaaatctgttttacagtgtcatatttcacagttagaaaggaagaaaaaccttaaatcaacaaattaactttacatcttatggaattaggaaatgaagaacaaatgagactcaaacttaccaaaaaataaaaaaaataaaaataaattacagctaaaataaaatagagaaaaatagaaaatttttgcaatagaaaaaaaatcaacaaaattaggagtagctgttttattgaaaagatcaacaaaactggcaaattcttagattaagaaatgaagagaatagacacaaacagcaacaactggaaattagaaaggcgatacaacaactgctgccacagaaataaataggaccttaaaagactaatatgaacaactatgacccaaaaaaatttgataacctttgagaacggatagacacatcaaacccaccaagactgagccacaaatacatacaacttctgaatggacctataactattagagattgaatcagtaactgtccaacaacgccagggcttcactgaaaactctaccaaacatttaaaaactaacaacccttctcaaactctttgaaaaaactagaggacagaacactttcaaaatcattttatgaggtaagcattacttagatatcgaaatcagacaaatttacaagaaaaaagaatccctaataaatactgatgcaaaaaaaatcaacaaaataccaagaaacagaattcaacaatgcattaaaaagattatatttcataaattctcaactggaatttattcataaaatccaaggatggttcaacatacaaaaaaatcactttaatacactgcattcttaggacaaaaaccaataatctcaactgactcagaagaagcatttgacaaaaatcaacacccttttaggatttaaaaaaaggccagacagggtggctcatgcctgtaatcccagcactttagaagggcaaggtgggtggatcacctgaggtcaggagtgtgagaccagcctggccaacacagtgaaaccctgtctctactaaaaatacaaaaactaatcgggcatggtggtgggcgcctgtaattccagctactcgggaggctgaggcaggacaatcacttgagaacccgggaggcggagctggcagtgaggtgagatagcatcattgcactccagcctgggtgacaagagcaagattctgtctcaaaaaaacaaaaacaaaaacgctcaattcgctagaaagatatggaaattacttcaacataatgaaggccatatatagaaagaccacagctaatgttattcaatgatgaaaaactgaaagttttccctctaagatcacaaatggaacaagaatgcacacattcaccacttctattcaacatactgttagacatcctgccagagttagcaactgggcaagaaaaagaaatgaaaggtattaaatgagaaaagtaagaagtaaaattacttctgttagcaaatgacatgatcttttatgttgaaaactctagcctaccaaaaagaaaaaaaaccgttagaataaaggaattcagtaaagttacaggatataaaaaccaatattaagaaaagagttgcatttctaaatactaaaaatgaagaatccaaaaaggaaattaattttttaaacccatttaaaatgaaatcaaagagtaaaaaatacttagggaatattttcaccaagcaaatgaaagacatgtacattgaaaattaaacaacataggccggacgtggtggctcacgcctgtaaccccagcagtttgggaggccaaggtgggctgatcacgaggtcaagagattgagaccatcctggccaacatggtgaaaccctgtctctactaaaaatacaaaataaattagctgggcttggtggcgcgcgcctgtaatcccagccactcgggaggctgaggcaggagttgtcacttgaatttgggaggcagaggtgcagtgagccaagatcacgccactctactccagcctggtgacagagtgagactctgtctcaaaaaaaaaaaaaaaagaaaaagaaaattatacaacaatgctgaaagaaattaaagacaatacaaataaatggaaagacatccaagtttatgaattggaagatttagtactgttaagatggcaatactacccaaagcaatctgcaaattcaaagcaatccctatcaaaatcccaatggcattttctacagaaacagaaaaaaaaaatcttaaaattaatacagaatcttgaaggaccctgaatagccgtaacaatctggacaaaaaacaaagctagaggcctcacattccctgatttctaaagatattgcaaagctatagtaatcaaaacactatggtgctggcataaagacagatatacagaccaagtgagcagaagagagaacacagaaatagggaaaagaggttcttcaacaaactgtattgggaaatctggaatctaacatgcaaaagaatgaagttggagccttatctcacaccatatacaaagatgaactcaagctggattacagacctaaacttaaaacatcgaattataaaactactacaagaaaacatggagaaaaagcttcatgacattggacttggcaatgatttcttgaatagatcaccaaaagcacaagcaaccaaagcaaaaatagacaaactggggatacataaactcaaaaatttctacaaagcaaacagtaaatggagtaaaatggcaacctacaaaacaggagaaaatatttctataccatgtatctgttatttggttaatatccagaatatataaataactcctacaattcaacaacaaaaaatctagttaaaaagtggacaaaggacttgaatagtcatttttccaaagaatatatacaaatgggcaataagcccatgaaaagattctcaccatcactgatcagtagggagaaatgtcaattaaaactgcaatgatacatcatctgaaaccattaggatggccaccattaaaaaaacagaaaataagtattggtgaagatatggagaaactggaacccttatgcaccactggtgaaaatgtaaaatggtgccaggcactgtggaaaacaacatgaaggtccctcaaaaaatttgaaatagaattacctccagttccacatatgaagagcttggaagtcaccactccatcctaacaacaagtaaaaaatgacaaacttaaaaataaacaaatctgagataggataagtgaggtcacagggcaaatgactgcctgtgagagcagagaacaggtgaacacatagcatcaccatttatctgagatgaaaaacacaagcagaaacctccacggggtaggaaatcctgaagtgtaatagacaaattgatgaaggctcagtgtggacaactctgaaagctaaaaactccagagttacccaattatagggggagccctacaattttctaagttttacatccaggcaattgaccagcttctcacagtaaatataggagaaaaatcctcaaccctcagcaggggaggcaaagagaaatgattttcaagtacactagactattccagtcttaacaaggtttgtcctcaggagaaactagttaaccagagcctaacctgctggggttgtagcaaagccaaaatgatgtgggggaagagaaataacccaacttcaggccattatagctatcttgttctaactaagggaatgagggaggggtgggattgagaaacacttgtgaagttcacagtccagaggcataagctcactaaaaagactgacctaatcataagactacagaactcttctcctctccctacaccttacaaccacattactaaatgctcatttacaacagttccttttacctagtacatcatgtccaagctatcaagaaaaaaattacagggcataataaaaggtaaaaaacaagcaccaggaccagatacagcagggatttggaattatcaaacttggaatctaaaacaactatgattaatatgctaagggccctaacgaactgagtaaacaacatgttaaaaaagtagagatgaaaatcctaagaaccaaaaggaagtgctagagataaaacacaaacaaaaacaaaaaacagaacactgtaagagaaatgaagaatgcctttgatgggcttattagtaggctgggcatggatgaagaatctctgagcttgaaaatatgccaaaaaactacatctgggcataaaacgttgtaattacagaaattcaaggataagaaaaaaatccgaagtaagccagagggaaaaaatcaccttacctgtagaggaaaaaaagaaaaaaaagaaaaaatacatgtgacttccaacaagaaaaagagtgaaatattcatagtgttgagagaaaaaaaaaccataaacctagcactctaccttgtgagattattattcaaaagttaaaaagaaacactttctcagacaaaaattaaggaaatttgttgtcagtacacctgccttgcaataagtgttgggaagttcagaaactgaaatctacatatatagagcatcaaaagaaggaaacactgaaagtaaaataaaaccttttatttttcttatacttaattgatctaacaaataagaatttgttcaaaataatgtcaacaattgtgcttatgcatacaaatgctcctaaacttacttattgggttgtgtcccaataccattataaattgaaaatatcatgaaaacacaacttatccaaatttgtgggatacagtgaaagcagcgcttagaaagaaacatacaacactgatgcatttattagaaaagaattatctaggccgggcgctgtggctcacgcctgtaatcccagcactttgggaggctgaggcgggtggatcacatggtcaggagatcaagaccatcctggctaacacagtgaaaccccgtctctactaaaaatacaaaaaaattagccacacgtggtggcaggcgcctgtagtcccagctacttgggaggctgaggcaagagaatggcgtgaacccgggaggcggagcttgcggtgagccgagatcgagccactgcactccagcctgggcgacaaagcgagactccatctcaaaaaaaaaagaaaagaaaagaatgatctaaaaatcaattatctgagctaccaacttatgaaactagaaaaagcaaattaaatccaaatagaagtaataaaaattagagcagaaatcaatgaaattgaaaacaagatatcaatagagaaaaatcaaagaaatcaactagttctctgaaaagatcaataaaatcaataagcctctagccaggctaagaaaaagagacaaaggacaaaataactaatatcagaatgaaaagagtggacatcattacagatctcatggacattaaaaggataatcaagggatattatgaacaactttacggccacgaatttggtaacctagatgaaatgaatcaattccttaaaagacacaatctattagaactctaagaagaaataatcttgattaaaaagcatatattaaagaaattaaatccataattaataatgttctaaaagagaaggcatcaggcccagatggattctctgatgaattctactaaacatttaaggaagaaaccacaccagttctctacaatctccttcagaagacagaagcaaaggagatgctcctatctcattgtatgaagtcagcattactctaatacccaaaccagacaaagacattatcagaaaagaaaactacagacccatatttgtcatgaacaaagatgcaaaaatctttgtattagcaaagtattagcaaactaaattttactacaatgtataaaaagaagtatacaccagcacaaagtaggatttatcccaggtatgcaagactggttcaatattggaaaatcaattaatgcaattcaccatatcaacagactaaagaagaaaaatcacatgaccataccatagatggagagaagtatgtgacaaaatttaacacccactcatgatagaaactagtaaactaggaatagagggaacaccttcaacttgataaagaacgtttacaaaaaacatacagctaacaccatccttaatgatgagaaactagaaactttcttactaagatcaggaacaagaaaagaatatccccacctcaccactccatactggaagtcctagctaagacaagaaaaggaaataaagggtatactaacggggaacaaaaaaatacaactgcctttgtttgcagatgaaatgactatatgtgtagaacatagacaggaattgaaaaaaagaaaaagaaaaacaacaaaaacctcctagaactaataagtgattatagcaaagctgcaggatacaaggttcatataaaaaagttaatagctttcctgtaaaccagcaatgcataagttgaatttgaaattaaaaacacaataccattttacattagcgtgtcccaaaatgaaatatttaagtacagatctaacaaaattagtacaagatatatgaggaaaaatgttttagaactctgatgaaagaaatcaaataactaaataatgaagagctattccatgacccgtgagagacaactcaatattgacagaaaaagtcagatggacactactgatttcaagatttactgtaaagctacagtagtcaagatggtgtggtactgacaaaagaactgacaaaacagaccaacgaaacagaatagagagcccagaaatggacccacatagtcaaaggagcaatggcagtatttgacaaagaggcaaaggcaatacaatgaagaaaatagtctttttcaataaacagtggtaataactgaacatccacatgcaaaaaaaaaaagagtctagacacaggtcttacacccttcacaaaaataaactcaaaataaaccagagaattaaatgtaaaactcaaaactataaaactcctagaggataacataagaaaaaatctagatcttgggtttggtgatgacttttagatacggcaccaaaggtaccaaccatgaagaaaagaactgataagccagacttcattaaaattgtctacttgtttcttaaaaattgttgtcttttgcaaaagacaatgtcaagagtatgaaaagacaagccacagatagggaggaaatatttacataagacacatctgataaagaactattaactaaaatgtgtaaggaggctgggtgtggtggctcacatcccagcactttgggaggccaaggtgggtggatcacctgaggtcaggaggtcgagaccagcctggctaacatagtgaaaccccgtgtctactaaaaatacaaaaattagccaggtgtggtggtgcacgggtataatcccagctactcgggaggctgacgcaggagaatcacttgaacccaggtggcagaggttgcagggagccaagactgtgccactgtactgcaacctgggtgacagagcgaggctctgtctcaacagacagacagacagacagacaagacagacagagacagtgtaaggaactcttaaaattccacaagaaaacaaacaacccaattaaaaaattggccaacaaccttaacagacacctcaccaaagatatacagatggcaattcagcatatgaaaagatgtcccacacatcatatggcatcagagaaacacaaattaaaattataagatacctctacacacctatcagaatggacaaaattcagaacactgataacaccaaatactggtgaagatgtagagcaaaagaaacactcactcattgctggtgaaaaatgtaaaaggatagcgtcatattagaagacagtttggatgtttcctacaaaactaaacacttttaccataagatccagcaattgcactccctagtatttacagaaagtcgctgaaaacctaagtccacacaaaaacctgcacaccgatatctacagcagttttattcataattagcaaaatgtggaagcaaccacaatgtccttcattaggtgaatattcattcacaaactgtgatatgtccagaaaatggaaaaagagaggtactaacaacctatgaaaagacatggaagaaactttaatgcatattagtaagtaaaaatagtcaagctgaaagggctatatactgtatgattacaagtatataatatgctggaaaaggcaaagttagagacacagtaaaaggatcggtgattgccaaggagtgggagggaaggaaagataaataggcagaacacagaggattttggggcagtgaaaacattctgtatgatataatggtagatacatgtcattgtactttgttcaaagccacagaacgtacagcactaagaatgatccctaatataaactacggactttgggtaattatgatgtatcaatataggttcatcagaaagacatgtaccactctggtgggagatgcacactggctatgagagaatccatacatgtgtgtggaaggaggtacaggggaaatctctgtaccttcctctcaattctgtgaacctagaactcctgtaaaaaaaaaaaaaatctaaaaaaaaatagaatacatatgatccagtaatcctacacctgggtatacttccaaatatattaaaaacaggttctcaaaaaaatatttgtatacccatgtttatttcaacattacaatattcaagaagtggaaggaacctaaacatccatcaacaaatggttaaagaaaatgtggtatacatatataacaaaatgttattcagcctaaaagaaaagaaagaaattctgtaatatgctacaacacaaatgaaccttgaggacattgctatgtgaaataggccagtcaacaaaagacaaatacttaatgattccactgacatgaagtagccaaaacagtcaaattttagaggcaaaaagtagaatggcatttgccaaggaataggaagaagggggaaaagaagagttgttcaatgaatgtagagtttctgttttacaagatgaaaaagttctagagatctgctgcacaacaatgtgcacagttaccacaattgtaccgtacacttcaaatcattaatatggtaaaatgtgttgtttttgacaatttttaaaactctaccccattgttttctttacctcttatataaactgataaaaacctgttttatcttaatcaattattgtatgactactgctccccagagaaaaaagtgcatgtgaaatactactacttatccatctcctggctctgagcagtacatgtcaggaacaagagggaattgtagctggaagacagtagaagagccataggacaagtctctaagagaaggaagaaaaggcgcaatgaaagaaaacaagtttaagatagtagaaaagcattcaaagacggcaacctgaggtaaggtgttttcactgaagcttttggggtaaaacagttttgagttggcatgcctgtagacatgggaagcagcagtgatgcagaggtgaacattactgtagataaaaacggatgggaatttgacttgctagggactgaggggttaatcatataaataaagatggcagcagatttgggaaagagtgaagaagaataagttcaggtagcagtcctcaaaaaccgagaagaaactgatagctcactgaaggcagacagaggaagacaaaaccagaaggcataagcttcaaaggagcagggatttttatgctgagagagtaaaaggaatagttcaaagcagcagtggagaacacgaataacgttccatgtgggaaaagaacatgtccagagcttactgtacctataacctagcttctgtaactggaaatgaagaatctgctctagtcaggtcatcacttttcactacttattttacttggccttcctaagaaatatagaccttttggaaattattgacttttgggtctaggacactatttcttggtttcctcccttctctctggctgtttttcagagacttcccttccaaatctagagacatttgtattctccagggatcagctattagatactttcccttttaaatttccctttggacagtttcatctttcaaggattgagcaataactaaatgacttccaaatgtctacttcagtataaattctgcttgtcaggctacataaaaagggctcttcaaggaattatgatgtctaaagaaagagaaagccacgatttcaatatcacagagatgactacagaggaatagcaataaaaagagaggcaacttaggagaggtgaatcacaaaagatgactaggagctgatgacactatgggtgggaagaatgtttcagacaggggaagaatgtttcagatagaggaaaatgagtaaaagcacaggggcctgaaaacatgatattataagacaattccaagcacttcaagagcctaaagttcaagaaaagtttcaaaaatatgaaaatggagaggcagggaaaagccagatcatggaagacctcaatagccatgataagtaattctttttttagccaaaagaggagtaatctaataaaagctaaagatcttctcctcataaaaatacatgcacacttcaggagtgcaaatgcactcttccggaagattcgtaacccactacattcataaaccattagataagaactaaaacacaaggagtcactgaagggttttaagcaggttaagtgactgacaaaatttgccttttcaataactgaaaccaaagtgggcaaaactggaggcaagcaatccagttaggtaatgactactgtaatagtccggacaaataatgtagcagtaggaagaaaaaaaaagatgaaattgacccaggaaatatttaaaataagtagtttgtaagaggtaaataagctggaagagccagaggtaatgggtagggtttctggtatgggcaacaagatatgctacaagctgagatgttagtaaaaacaagcgttcatcagcatttagtaagtgatttatttatattatatcactgaatactcaattatgttaagaggcagacagcagttaaaaaacaaagaactcggtgaatcaaaaagttctgctaatttggggaaatagcatcccttttatttttgttaatctcttttgggtttgatcctcatttatagctgacaagaagttctatgtactaaaggtaaactattctcattaatgttcccaaaaatctcttggaataattaagatataaagaaattcaaaattcacatgattataaaaatctttccttagataatctcataatatagccatgttttgctcattctactttgagaagattcagccagaaacagttcatccattcaactatccctactgtgaactagaagtatgtttccttacatttgaaacagaagatataggtttatatgatgcttcaggtggtagaaaagcagggcagactatgactcgtgtcacttccttccacacgtgatgcctttcatgggctcctgtgtctgtcagaagaaagcaaagggccttagcgtgctcctggctttctatatccaaatgcattttttcacaccttctcccatcagctaactctacattactgcaatacggaacttcttactactcagtggacttgttctgctgtcttctctgattccaggtgttattcttcctgcctagaacactatgattcttagctattcccaagcatcctcaaggtttcagcttatataccacttttaagataattaggtattcttcctctgtagtctcataccaaccagtacctattctattatatataataactgcctattaattaaatgggaagctgaggtatatgacctaataacttatttactgtcgtatcctcagaacctagcaaattacagagtctcaacagagatttttcaatttctcttctgatactgtctcgataacagtgtcaattaaacctttctctaattatttgaccttgaagggaaatagatgtcagactacctcctggtttcgagtatactggaagcatacaaaaggaccttctcaatctggagaccaagaatatgatatgagaacctataggagaaccacttatttgattaaagagatttcttttacttcagaaaatatttcagtatgttacttgacccataaatgcttatagatgtgtaagtacaccgaagaagtcatataggaaataaaagcatccaagctatatttctatggtctactctgattaaaaagctcagctctcctatcaaattcaagataatgcatgtggattatggagcacagtcacttgctacatggtaaatgctcaaaaagatgataggtggtattacccacattctacaggctgtgtacatacttatcagtttatatatatacataaactgatcctaaaaaattcttcctacatttctgcaagataattaaaaaggcagaaacaaacattttgcataaatttactagcttcattctttcatgtaggaagtagttactgactacctactgtatgccaggcactgtcattaggcttccattctagtggtaaagaagcaaaacaacaaagaaatcaatatgcaagaagtcaaatgacattaaatcccatgaagaaaaatgcagcaagttaaggggaatgcagaagaacatgatcattctttgatgcagccggtcaggaaaagcatcatttgagcagagagctctctgaatcaagtgaggaaggaagccacatggattatcacagagaagggtcacagggtcacagacaatagttacaagccttaagatgacaaagatacagccattttagacagagatgagcaagtgcggtagagagatcacagaaatgaaaggaagccagttcacacagggccatgtaaatctccagattttacttttaagatgggaagcctctgaaaagttctgtgcatagtaaataacatggtttaactcagattttaaaaagatcattccggctgctactagagaatacactgtaaagcacaagactcctgggaaacaatttctttcttttgccaaaagatgatgcctttaaacagagtaaacagaagtataatggttaaaaaaaataaaatgaattatgggtatttggaaggtgtagccaacaagatttaccaataatttgagtatgtgacatagagaaattaaaagatgcttccaaggcttctggctgcacaggaggggaaaaaagctgttattgactgagatggcaaaatattatgagagacgtaggtttgggatgatgaaaatcaggagctccacttaggacaggttaagtttgagaaccagacttaactgttggataaatcagtctacagttcagagggcaagagctgacgatggaaatagaagagttgtcaatagacagagtcctggggcatttctgacatttacagtaaactgagcatttattaaaactaacttgctttactgaaccataaatcacttgttgtatttacccctgctccatttatagttatacatctggaaacatagccttagtgttagaggtaaagagtaaataccaaacataaaaaatctgatctggttgggtgcggtggctcaagcctgtaatcccagcgctctggaaggccgaggcaggcagatcacgaggtcaggagttcaagaccagcctggccaatatggtgaaactctgtctctactaaaaatacaaaattagccaggcatggtggcacatgcctgtaatctcagctactcgggtggctgaggcaggagaattgcttcatcctgggaggcaggggttgcagtgagccaaattgcgccactgcactccagcctgggtgacagagcaagattccatctcaaaaaaaaaatctgaagttactgagaaactggtatgaaatcattaagaaaactaaggtgtctaaattaatacatacaaagagattctacaacacggtatttataaatttaaacaaaatccatggccaggcacggtggctcacgtctgtagtcccagcactttgtgaggccaaggcagaaggattactttggggccaagagttcaagaccagcctgggcaacatagtgagaccctgtctctacaaaaaacaaacaaacaaacaaaaacactgttttagcctggcatggtggcacatgcctgtagtcccagctactcaggaggctgaggcatgaggatcacttgagcccaggaattcaaagttgtagtgagctctgatcacaccactgcactctagctgtatcacttatgacagagcaagacaatatctcaaacaacaagcaaacaaaacaaaaaactaaagtaaatccaggtaaaataaacatacgaataaatgaaaagatctgggttattgcattagttctgtttctaggcttaactacaaaatggtgtccagttgttaaaaacacttgtttaagagtattaataatttttttttttactatgctcttctacatcctaggaaattggcaacactaagaattcctaaaaacaaacaggagtgttaactgtatataaattattatttaagatgcattcaaggcgttacttaaaatatcaaatgcatgtcaaagtacaaacaacaaaatcatgcttcaacaaatgtgggatgttgccattaatggacagttagctctgaggtaaaaccaagaatccttcattacctatttttgtaaattaggacaaatactattaaggtattaggttggtacaaaagtaattgaacaaacctggacccactcacctcactgaaagtgctgcctggctacagtttctagatataggaatgtgagaaatggtagcagccttgaaggtttagagctatattcccataccaattatggctagaaacttaaaacagctctattgagacattatgggaagtctaatttcctgttactctactttaacacagccaagtaaaacagtaagaaagcttgcttaattcaacaaggactgagtgccagagtgtcacctggaaacttgtgacaaataatcatgcctcacacattcatccttggtttttactaccaaatgcaagcttcatctatcctcttccattctaaacttgactcatcctcctaacctcttccagaaagatctctagaaacccagaggctttctgaagacccataggctatcccccatcttcaactactttacataatggcccctcaacttcttagctttcatgaaagcctggctcctccccaaaggcactgcctatcatgcaacccttttatgtgactcctaaaactcctaagtccaccattattcttctaattccctgtattaaaaataaacggcaaaattccctgtattaaaaacaacaaaaaaacagcttgtaatttgaaactcatgtcatctaaccgaatgccttctctttccctccctgttctggtcaattaaacccacatatttaagcctccactttgcccccagttacatcatcagcaaagtgacttcaatgtccctgtacatggttctatcccaatactctaggcccccaaaatatttgcctttctaaatttgagacatcttcacctcctcatttcagcaaatcactcccttgtctttgttagacatactaaaacctctgacaatgatcatctcagctatctttgtaagagtttcactcatactcatatctcctttcacctgtcaagacaccaggtttggtgacaaataaaaatgatacgtatttgggaggctgaggcaggagaatcatttgaacccaggaagcagaggatgcagtggccaagatcatgctactacactccagcctgggtgacaaagcaagactctgtctcaaaaaaaaaaaaaaaaaaaaaaaacacaaaaaacaaaaaaaaggatacatatttattgtattcacatgatgttccaaaatatgtatacactgtggaatggctagatcaagctaattaatacatgcaatacctcacatacttatattttatggcagaacatttaaaatctactctcagtgatttccaaaaatacactgttattaactagtttccatgttgtacaatagataccttgaacaaattcctcttaattgaaattttgtgtcctctgaccaacacctctgcaacccagtccactcacccccagcccctggtaaccaccattttacatccctgagttaagattccacatttaagagagatgtagtatttgcctttctgtggctggcttactttcaacaatgccctccaggttcatccctgctgtcacaaatgacagcatttcctcctttttatggctgaagtatattccactgtgtatacataccacattttctttatccatgaacacttaggctgatgctgtatcatgggtattgcaaatgataccgaaaggaacatgggagtacagatctcttcagcgcactgattttattcttttatttatatatatatatatatatatatatatatatatatatatatataaaaatacatatatatccaagtgtgactgctgaatcatatggtagttctattttttaatttctgagcaaacgtcatgctattttccataaatgctgtactaatttacattcctgccatgcgcaatatatctcttgtctgcaaatcctcatcatactttaatagccattctaatggccatttgtatgtcttattttgagaaatgtctattcaagtcctttgcccatttcttaagtgaggtgctttcttactattgagatgtctgagttccttatatattttgcatattaaccccttaccagatatatggtttggaaatactatcttccattctgtgagttttttcattctgtagattttttctttttgccatgcagaagctttttagtttgatgtgatctcattcatcaatttttatttttgttgcctgtgcttcgagggggtcatatccaaaaaaatcactgtccaaaccaatgtcatgtacatttctcctatactttattctggtagttctacagtttcaggtcttatatttaagaccttaatccattttaacttgaatttggtatatgatgtgagatacaggtctgatttcattctcatgcatgtagatattccattttcccaacaccacctattgaacagacttccctttccccgctgtgttctttgcaccctgtccaaaatcaactgatagtacacgaatttatttctgtgctctccattctgttttgtgggtcgatgtgtctgtttttttgtttcttttgtttttaaaagacagggtctcacgctgtcatccaggctggagtgcagtgatgcaatcacagttcactgccaccttaagctcctgagctcaagcaatcctccttcttcagcctctcgggtagctaggactacagatacacagcaccgcgcctggctttaaaaattttttttttttttaattttagagacagggtctcactatgttgcccaggctgctctcgaactcctggtttcaagtaatccttctgcctcagtctcccagagtgtgggaatacacgtgtgagcaactgtgcctggcctgtctacttctatgtgactatcatgctgttataattactgtagctttgaactatattttgaaatcagatagtgtgatgtctccagctttgttcttttcactcatgacagctttggctatttaggatcttatgtggttccatataaattttagcactgttttctagttctgtgaaatttaacattggaattttgatcaggattgcattaaaactgcagattgctttggataataaaaacattttacaatattaattcttccaatccataaacacaagataactttccattatttgtatcatcttcaatttctttaatcaatgttacatagttttcaactctttggttaaagttatttctaagtacaatcatccctcggtatctgcaggatattggttccaggatctcctgtagataccaaaatccatggatgctcaagtccattatataaaatggtatagtatttgcatacaacctacacacatcctcgtgtatactttaaatcattacttagtacctaatacaacgtaaatgctatgtaaatagttgctatactgtagtttccttattgtataagaaaacagtatttttattgttgtatttttttctcaaatattttcatccaaatgttggttcaatttgcaaatgcagaaccactgatactgggagccactgcatgttttgtttttggtacctattatacatggaattgtcttcttgatttttcttttagataatttgtcattaatgtacagaaattctacggatttttgtatcttgattttatatcttacaactttactgaatttatcagttctaacaattctctggtggagtctttaggtttttctatatacaagatcatgtcatcttcaaacagggacaacaatgtcttcctttcctactgggatgccttttctttctcttgcctaattgctcttgcaaggacttccggtactgtgctgaatagaaatggcaaaagtgggcattctcgttttcttcctgatctcaaaagaaaagcttttaacttttcaacattcagtataacgttagcagtgtgtttgtcaatatggcctttattttatagaggtacattccttctatacttaattttttaaaattttgtagcacaagagaatactgaattctgtcaaatgctttttctcaattatctcaattatctattgaaatgataacatggttttggcctttgttctcctaatgttgtatatcacattttatggattcaggtctgttggataatccttgtacccttgaggtaaatcccatatgatcacagtaaatgatccttctaatacactgttgaatttagttattattttcttcagaatttctgcatctaaattaagaatacgggtctgtaattttcttttcctggagagttcttgtctggctttggtatctaggtaatgctcatctcccaaaatgagtttgaaattactccctcttcttaaatttctcataaaattatgagaacaatctgtactagttcttctttaaatgtctgctagaattcagcagtaaagtcaccaagtcttgggcttcctttggtgggagatatttttatgactgatacaatccttgtcactggactgttcacatttttcatttcatgattaagcttggacaagttgcatgtgtctaggaatttatccatttcttctatggtaatcaatttgttggcatataattgttcagtctcttatgatcctcttatttcttgtacttctctggtatcagctgcaatggttcctctttcatttctgatttaacttgagtcatctctttttttcttagtctagctaaagacttgttgcttttatcatcaaaaaacacaactctttattttttttatcttgagtcatctcttttttccttagtctagccaaataacctgtcttttgagttcagattcttttgtctgcttgctcaattctgcttttaatgctcttttgcatttttcattccatttattgcattttcagcttcagaatttgttaaaaaataatttcaatctcaaaatttctcattttgattgctgttttcctgattttgttgaattgtttatctgcattttcttgaaattcattgagcttccttaaacaattactttgaattctttgtcaggcagttcatatatctccatttctttatggttggttcaggtgccttattgtgttcctttgactggtgtcacgtttccctgactgttcttgatccctgtagtcatgtgttggcacctgcacatttgaagaagctgagacttgttccagtctttgcagagtgactttattgggtaaagcccttcaccagtcagcctgtccagagattatgcagcctgagtctaccggggctggcctggagtctgggtcagcagggtaggtcctggagccttggtacacaggtgctgctggcctggcatcctggtctactagagtgagcctgaaccttggatctgcaaggaccagtgtgaaggctgggtaggtggatgttggcctagaatttggatcacaaggggctggccaagtactgggtttggacccttgttctgcagtgatgtgaggccacaggggccgatctagagggcagggctgcagggaccaccctagcactagacaggcttagagcctagggctgtgggatccagcttggtgctggggtgggcctccaagcttggtttgtgggtattggcctgaagtttggggccatgggggcctgcctagcattgagttttactggggcgagctcaatgttagggtctaagtctggtgtacacttcccctccttcccccaggtgaacagtctctctctccatgctgggatctcagggactgagggaggtgtgacacaagtaatgtaaaactgtccttcttacccttttcaatgtgtcttttcttatctgtgtgccacattcaggtaatctctcgtctggtttcttagctcttatatttttgtgtgtagacagttgttcaaattgatggttctacaatgagatgagtgctgcaaagtgctagtctgccatcttgctgttatctagacctcaggcttttcttaaaacaactcaacactttggtctggcatcccaacctttccaatcatggccatcatccacagcatataaattcaaatactccaatgttaacatcttatgcacatgccactaatgattctgttccatcagctctgctaatatccaaccctaaaataccatgcataatcttctggctattggagaaaagtctttaaatttcaaatgtgataaagtctttaatcttaactagtcactcagtggaatgagattctcctactctgatacggtttctgatttcaggtagccagccagtcaagactctcaacttctgatccacttcttcacccattcccctcagtagcttcctaagttttcagtcttctcaaaacctctaaacaaaccttgtattccacaaaatattattaaaaaatgtttcataaaaagtttcgtggtcactaacctacagtaacatactaccttatatccactacaatgactactattgaagtacacacacacacacactctcacacaatatgtgatggcaaggatgtagagaaactggaccccttgtgcactagtggtagaaacgcaaataggtacagttgctctggaagagtatggcagtttctcaaaattttaaaaataaaattaccatatgatccaacaattccacttctgggaaaacaattcaaagcagggtctcaaaaagatatttgtacactcctgttcatagcaacattatctgtaatagctacaacatggaagcaacctgagcgctcatcaacaggtaaatggataagcaaaatgtggtatatacatacaataaaacattattcagcctgaaaaaggatgcaaattttgaaacatgctaaagatggatgaaacttgatgacactgcgaagtaaaataagccaatcataaaagggcaaaaactgtatgattgcacttatagggggtacttagagcagtcaaaattagacacaaagtagaataatggttgtcagaggctgtgaagataaggaaatgaggaattattgtttaatgggtacagagtttcagttctgcaaaacagagagttctgatcgtgactgtgcaacaatattaatatacttaataccattgagccaaatacttaaaaatggtgaaatggaaaattttacattatgtgtattttactacaattttttaaagcttaaaagacaagtcacatggttgggtcacataaatttgagaaatacattttatagtcgtttcttgcagattcacaatatataccggcatttaaataaggttccaatattttcagtaaaaaaatcttgatttttccaccctcacccacaattacaattaatatcacacatccatctttacttccttgttctaatttcattagatgggcatctttcctcttattcaaggtcaatcactatatctgcatttttctttttttatattacctgtatgagagatacacctgtatttttcattccaacccttaatacctcgaaaaactttgctttgataattactacctctattatctgaaacatctttagtcttcacaataaatcactaaagtcttacttacttcatgtcctaaatatttgtcttaaatccagaaaaatttattttgaattcctattataccactgtcattgtcaaggctctcactgactgaactaccttaccaccacacgtttctcttcaatcctttctctcttgcaaggttattaaaaatacacgtttgacaaacttactatctacctactgagcaaattctttgctgactccctaataccttctatcacatcttatcttcttcattttcctacctctcagctagtttatgatctaaaagtcctcaactgcctattgtcccctactccctatgctgcttctaactttggctcatacttctgcctggaataagccgctcatgcttctagctgcctgattcccagtcacatttcaagactgaacttagcatttcctggccactcttacttccctgccatctacactagattcctattgcatacctgggtactccagtactccttcatgttactattgtattttggataccattctacctcagtgactgaaattatttgcttctgcatctttcactcttgagtataatataaatttctgtagggtgaaaactaattattacgcatctctgtatctataacatagtacttgatgccttaaatatggtaggcgttgagactgttaaactcaactctttcctcaacctccctatttccctacaactgctaccagggaagcaaaaagactaagaatttaggcgtgtgcatttatctatctagtagtagaaacctagtaaactgttaccgaggtttagagttatctgataggaaaaaaagtaggtatgttcctatctcccatttactgctaaatgattcctttcttttaaccagaaattatttccaaataatgtgacgtaatttaaagcagtctagggcaactcaaaataagaaccacagtctcaaccaagttacacttacattcggctagcttcaatgtcgtcagactgaggttctcctgatctgtaaaatgcaattgagaaacagttagcaaaatattccatattccaaaaaaaaaggtagacatattacttaggaagacaattttgtaaacaagatttaagcactaaataaaacagttttaaaattaaagatgtcaacatgaaagaaagtggtcagatcaggtggccatacaacacatttattttaagggttggactattaaaaaactcaatgcatgttttttaaaggaaactgtaaacgctatacatagataccaacagacaagccattataagccataattattcacaaagtcaaatacgtgtaataaaacacacaactaaaaaacttcctatagccaagtattggttatccacattaacaaaggtactcactggtattcactcacagtattaaactttagattagtggctcagtaaactactccctaggcagacagactaaagcttaggccagccatgtagttttgtaaatgaagttttattgggatgcagccatactcattcatttaggtatcatctatggctgctttcacactaaaagaacagagctgaggacttgtggcagaaaccacatggcccataaagcctaaaatatttattttctggccctttaagaacaaatgtgccaaccgctaccgctactccagacaattcaaactaaaatctaataccttggtaagtttaaagacacttaaatcagatacaacattctaatgatgattatcttggttcaacaatgaaactgtttccctaaaaatacacttactgtatgtattacctgtcaaaagtgtatcacctgaggtgaagttttgcactggatagctgtgaattaacttcagttttaaacagttgccagttactttgttatttctaaatatactactgctctctcatgtagaaatatttaaaattctaagtcactaaaaagcctttcattttcatttcacgagatatgaatcagtatttccctatctattcacttttataaacagcatcagcaacaatgaatgagtcaatataatattgatttctaacacttagaaattcccaaactagataaaaaatgttttttgaggtcaaaagctaaattttcaaattggcattacaaagtcctgatttgtgaacttctcactgactttaggcttccaactttaagcaactctaacaagaatcttaaaatcagtcacacacacacacacacacacacacacgcacacacacaaacctgttttctaaatttcttagctaaaaacaaaaacaaaaacaaaaaacaacccctcacttctttatcagactctcaaaattaccctcactgcaattcattcagattccaaggacaagaatggaaaaggaaaaaaaaaaaaaaaaaagactccagcagctcaaatatttattttagatcttctttgcaatgtatttaaattttcaattttgcacaaaattacataacaactaaaaactggggcatgctggaggtggcagtgacttggctgtgacacaaatgcaaaaatttcactccaccctctcccccagggagcaagcaaatcacctatgtgacacacctggtctccaccagccttgtgggtaagtaccccaagattgcttccaaacttgtatctcccagacagaagagctaaaaattgatgataaccccatgtaccagctgactcatttttgaaagtgcgaccctccagcatcagatgtcatactgtaaggaggcagagctggcttgcaaaacaaaaaataaacctgctggcactgagggaagagaggcagattagaagttttcaaacacgtaggcagcaaaactttcaaaattaacagggaaagagaagagagggaaaaaatgaggacatgatgataggaaaataaaaatattactgcaaaaaggtaagacacaagaagaaaaacaaatctaagtcttagaagtacaatatgtaactgttacaaagttttgagatcctgaaatgggatagagtttaaatacattatcaaatgataactacatctatcttcccaatttctgttccctaagcaagagaatatgtgaactttggcatcaaaatgtttgccaccaaactgtaacatattaattactactttttacatatattaaagtaggctattaaaaaccattgataagacaagctaagtaatttaaaccaatccagtatagaagaagaaggattgaaagattattaccttaaaataaatctgtcctgggtctattaaacatagcaaagttgttctactcaaattggaaattgttttttaatcaagagaaaaatgaatatatgcagaactagcagacatttttcttgcagtaatttataatagtttctgtctgaatgaatttctactcatcctaataacagtatatttctagaatattataaataagttaccaaagtcccgaggttagaattcaaactctcaaaactatgacatatgccaggtgtggtagttcatgtctgtaatctcagcactttgggaggtcaagacataaggaccacttgagctcaggagttcaaggtcaacctgggcaacatgatgaaacctcgtctcttagccgggtgtggtggtgggtgcctttagtcccagcaacttgggaggctgaggtgggagggtcacttgagcccagaaggtcaaagttgcagtgaactgtgatcgtgccactgcactccagcctgggcgatggagtgagaccttgtcttggaaacaaacataaactatgaaatatataccacctagcaacagttcccaagcttgactttggctcctaaagagtctacttattcttttactgccaagttgctggaagtaagaatcctgtatgtgcttgtaaatgcagaacatataacctaattcaaaacatataaccaaagggaaatttttgtattaaactattgacttaggttatcctaaagtgtgtcagaataacaagtcagaaattttaaaactgaaacaataaccaaataacattggataataaaatgtaaatctcagaatgagaatcaattttaggtcttgatttgaatcgcagaaaatatgatcacaaaacacccactaatctgaatactgcagcatgagctagcaaattcaaatggtggctcacttccaataacactggtgcagcttctccatcctgcaagccactccttttacctccactgtaactctctaggagagaaaagtatactagttttattaatgttataaaaacttctagagaaatgtttagttaaaacgttcaccacataaaaggcatactttaaaatgcatattaagaaatttttaatgttttctataatgtttatagtaaaatgtttaaaaccttgaagtttttttgagaaatactttcctgtttatacatacagataggtctttgatagtggctactgatatttttaatgagaaaaaaagacactaaaatattttaaggagattaaatgaagtaggtcaactctcaggcccactattcttagcagtattcctgccaactatacattgtcttcatttttacagtatgtatttcactttacaatgacagccttttaaaggctgtaaaataattcaaaattaccttttacaagctgtggccattcggtgacatcagggtgatcacagctttgagtcactgattaaaaacaggttgtcacaccagtctagctgctaccttgatctgagcgtaggcttaataactctaataaattaaacaaacctttggttagaacactttaatatataaacccaattcattgttcaaaaaataatattcaaagcttcaaattaggtgtcaatgtaaaattcatcagaagagtaattattatagaaaagtttttaaggactattttccagcattttgtttttcttaaatgatctcttcatttgagaaaatgtaataattccttgtacttttatgtaatgttatagtttctgaagcattttggtcaatagtaccttgagtcttataacaactttggctttacctaatcaagacagataatatactaagaattaaaaaaaaaaaaaattaagcagcctccgagtgattaactgacttgcccaagattttggaactagtgttgaaggactgactaaaacccagatatactgacttcctatcaagggatggatttttttgtttgttttggcttagttttgctatactgggtttcaagatttaagtatatgtaaatgagtaaagattcagaacacagattgagatctttcaaatacggacaaattcagtcaaaagattcctaagctgatagagcaatcagtcaccaaggagggcaactgcttaatggaatagttatatacatacacataaacacacacacataaacacaaagtctagtcccactaattctgtatgtacgtaaagtcatttaacatcagtcaccgcatgttctcactcacaggtgggaactgaacaatgagaacacatggacacaggaaggggaacatcacactctggggactgttgtggggtggggggaaggggagggatagcattaggaaatatacctaatgctaaatgacgagttaatgggtgcagcacaccagcatggcacatgtatacatatgtaactaacctgcacattgtgcacatgtaccctaaaacttaaagtataataataataaaaaacatcagtcaaaaccccttaagtactgcataaaaatatattctactctttcttggccataaatctactaagatttaatttcatgaaaaagtatggcaaaagatgaaagcatatcctcctccctcaaccaaatatctttttaaccccttacatggccttagctgaacttttctgattgtcacagttcaaatttagcaggcctctttactgacactgtagttctggcaaagataccatacatctgaaatatcccagtatcaaaagatcattttgtgcaactagttctttcccctcacgattcccctatccaggccaaatctgaggcatcaactacggaaagatgaggaaattaggaggaagaaacctttcataattaacatcctcaaagcaacaatagtcaagcgtaaaaggtggttaccagtgtggattcagaacccaatataaaacagcaaggtatctgcgaataccaacggttaaaacatgaatgtttgagcccatacctatgcagctatgaacgcagggcttcaaaatccagattaggtgaggattggcctgaatatataaaaataattgcaggggattccaataaatgggatttatagtatctgtaagaaataacgcaatctcccagatactcctatcctaactatacattgcctaataagaacttagacattgctgaggtcatatgggaaacaccaccttccctaaaataaacaatgtggtcatgatacagcttccccttgggttctcaagagactaatggtatgtggaattagaagattcaaacaagtctaactttccatcttgtaaacacaaaaataataaagttaaaatatcttttaattgactaattgacctcaatgtaattaaagagctatatgtattttgaaaactagagtcaagtcctctcttccagtcccctcttttatgagatccggtgctcaaaaggctccaaggccaggctggacttatgtctctgtttggtcattcactagctgagaaatcttgggcaagttacttaacctctccgagtctcagtttccttataggtagaactaggataatagtacctattccatagagctgtcatggataaacaagctaacatctaagtatctcagaacagtgcctgacataatgtgctcacaaatggctgggcgtggtggctaacgcctgtaatcccagcactttgggaggccaaggcgggtggatcacttgaggccaggagttcgagactagcctggccaacacggtgaaaccccgtctctactaaaaatacaaaacttagccaggtgtggtggcacacgcctgtaatcccagctacctgggaggccaaggcatgagaatcacttgaacctgggagatggacgttgcagtgagtcaagaaggtgccactgcactccagcctgggcaacagagcaagactctgtctcaaaaacaacagcagcagcagcagcagcaacaacaacaacaaatgaaagctattattaatactcatagcccaaaatccaaacctgccctctcaatctttttatgcatattattttacctctcatagcacactaatctcttgtaaattttttcagcaccctacctgggtccctcatacagtcttggaagtgtagttagtgagcacctgacacaatgctttaaaaatggcaggggcccaaatttgctgaacacatctgtcattattatgacattaagatacacatgcaatacgaattccaaaaaataaaacaaaaacataccatatttcgccaaacttctgaggagctggtgaattctaaaatcaggctcttacagatttttaacctaaaatataaaacacctcactcaattctttttacataaacaactggatgaactttcaaaaaaaaaggtactaaatttcatcataaaggcaaatttattttctataattatgaacatccaaaaacgtatcaagaaacaaattactgctgttgccgggatgaggaaagcataggtaggcaggccctgtggcctgagtgctttcagcaggcaaagccatatttcccatattcatccataaagcttagtgccttctatttatttactctatcctccctccaaaagggctaaacacatatgaaaactatttgactatatccctctaatcctttcaaatacctatagcaattttgtttttaattaaattctatatgctaagcatcggctatgttaggtacaaatctgggcatctaccactttctagagtagcagccttgggccgaccctctgacccttgagtctccaatgtcaggttattgtagcagagaaaatgcgttaaaaagttatagtataatgcctacctggcacaaaacaggacttcaatatacgacgataattataatttattaaatcaaccacttaatatatatcaaaacttaactcttaaaaaaaaatcctgaagcttaaagcaagcccctaaattatcactgtaaattcttaacttgtttgtatacaatcagaacattcctcaatggaacaaaaataaagtcctttcatgtactgcattacatataaagaaagcaaatctcaaaggttaagaaacctatccagtgtcctagaggttgatggtagaaagtgaatacactgcatataaaacattttgaaataaaattaaccaacttttaaggttttagagactgactttcaaacttcagtctataatagaattacctggggaaatctaaaaatgcaactacttgggctctactcgcaaagattttcattcagtgcatgaagtaggggtaaatgaattttttttttaatttttttcagaccaacccaagaacgcagaaatgaatttgcattttaacatatacttcacatgacacacagatctcattttaagaagccctgccttccaaattatgagttaggaacacataatcatggaggaaatataccaaatctataaaaatacagaataacaaaaactgtaagcactacaaatattaggcacactcacttgccaatttaaccataagaatcctaataccagacatagttctcttactttatctcttcaacagagggctcagtctaataatcttataaataagtatagtctaataataaatgcctatgttgatctatatctacctccctaaaattttcattttattcatttctatttttccttcacctccttctaaagctgtttcaaaacttaatttcacaaactgtttttttctatcactttttattataacacccaacacttctgttctcctttgcatcatgtttatggtgtcttatatttatggataatgctacttattaaaactgtctaagttttgtccgtttacacatttcacaattaaaggactactacaacaattttcctaagtcctcctgctttagtttctccttattccagtccattctgcagttaagacttaaaaagttttaaatactgctttcaaataatacttgcaacataattccctcaactccattagctcctcagagtaccatttctttatcttctttccttttactgccaaaaagacgtgaaaaccactagctcagctgctatttttctatctactgaaatttttcttgtaaagtttccatcatttctgtatattcccagtgctttggccccttaatcctacttaatttttgtagcttttaagactgctaatgactcctcacctcctctggcttccctaatgttgtatccactcattttcttccatctctctaaaggcaataaggtcttctgctagttcatcttcctacctcatacatggcctctctccaagtttctgtcaatagccacttttcttaacctaaaccaattttctgcgcaatgtcatccattcccatagcacctctatgcttacaaacccctaactctgtatctttaagtccttatgtctggcatggtatgcctgcaactacatattaccaacggtacacatccatttggatgtctcattaacatctacattcaacgtatctaatatcaaactcaattattttcccaaagaactcactctgcctaatctcactgtcctggttaaggactaaaaaaattggtgccattcattactttctccccctcatttttatttgccctaaccactgtgtaggttgatacttgttcagccttcaaattcttcataatcattaattcaaaaactgtctactagattttgagtgcctactaggtggatgaagatgcagaggtagaaaaactagacataatttcttgccctcatgtggtgaaggaaatgggcacaaataaaaaccacaattaattatgcaataacaatgcacagttaagtgttgtgatggagagatacagggggtgttaagttgtgtactgtaataaaaagtccttagtctgaagaaaaggaaaaccattctttatgagggacaagcaagatttacaagacacactaagaaaaaccctgtgaggtaatgatggtagcactatcagtccagctgctcaaattggaagattctcagtcatattctaaagagtctctctctttcccagtatatcaaattgtttaccaattgctaccaattcatccttagaaattcccctacatttctacattctcacattattccccagtcttttttgattgcttttagttgcttccagaataaagccaaagctcccaatcacgtcagatgagattctacacaatttggtcaaaacctgccagtgcagcctcttcttacagactagaccagacttcaagagaacatgtgtatcatttgcttttatacttccagtgcttgcaaatgtttatagaataagcatcttacaaaagagaaaatttttctcttagggaactagctttcagtcctttagtaaatgcaaggttaagattcaaaccctaatttgtctgattctaaagaccacgcttattcccttgtacttgccttctaatttatactcaaaccctatgaatttccttaaaaatatctcttactccttttttcctcaaacttaccaacactgtcctactacagtgccccattatttcatctggtttcccttttgcctttatcctcaactttgccactagaattatcttcctaaaaactcaaagttacacatatcattctatattcaaaagctttaacactttctcatgccaacagaataaatttctaactccttcacattttatttgaggcccctgccatgtggccctgaccccagccatcccagcactactgcccactatatgacatcatcaccagttaccagatctagtcccatcatttgactattggctataatgtactggatatttgtgtttctgacttcaatgcttttgcttctgaggagacttcactcggaaatggtcctctatccattactaacctctatcccccacccacctatcatgccatgttaaaaactggcctcattctaaacactgtatctcacagggttatctaaactcttatacataatcaccatctccttcatgtcttattatacattcttaataccataaaataatttattaatttctccttatatttattatgttataccttacattacagctatctgtatacatttgtcagtgcctctagttgtaagctgattgatggtagggatcatctcttccatattttacttttcgtaataatggtgactatgttttcttgacaccatacctcccctctacaagaaaaaaaaaaaaaaaaaaaaggaatcaggacccatggcctttgagctagttccaaatgtgactcatagatgaacaaagataccatttcttcccaaattaacacaaatataagtaaatgccaatttaagaaacgttttttcaaagactaaatatgtaagaataaccaaaacaattgtttctaataatgttcctttctctaccagatattaaaacatattaacttaaatggaataattaaaatcggcatgcctttaaaaaactgagtatacactaaatatatgcataccttatgacttaaaaatttcactcttaagtataccaaacagaagtaaacatattcacaagaagacaatcactgaaatgtttagagcagcagcaatattcttaacagttccaaaccaaaaatgattaaatgtccgtaacagcagattaaactatggcatattcttaaaatggaatatcacttccattcttaaaatggaatatacagcgactatcataaacaattactacaaccaacaatgtgaataaatctcacaaatacattaaaagaagtcagacacaactaaatgtgcttgattctagttaaaggatgaaaacaggcaaatctaatctatgctatgagaagtcaggacagtggttacacatggaagaaaaggggtagtgacacagagcacaaggggctacgcaggagctgctgctgttttttgatctgaatgctagctaaacgggtgctcagtgtgtgaaagtgcaacaagctatacacttagaagtgtatagcttaaaacattctaaaaaaaaaaaaaaaaacctcatatggtattagcattagacaaagaggtaagcacaacaagcacaacagaaagctaatttcagagaaagatccgaaagtatctgacagttgctccttctcaaacgagaattttcagaccttggataacaggcagcagaggactataatgcatgaaaggacaaaaacaaaggaggtgagccatccactgcttggatgtctgcctggaggtaatttccaacctgcagtcaatggaggggaaatccagtgagaagacagcagttttactgagttcagaatcaagagatcagagctgagaaagctgaagtgggtaaaattgatgacaagtgccagacaagtgcttgtctgagaaggcagagaaatggcttcagaaatctgccatttgagagtccactgctgagtactaactgtacacgattaaggtaagtgactccatgaagctagtgaaagaggggcagtaagctgaaatattcccagtacttataaaggactgggagactcctaaaattctctctaacctgagtgaagagaacacggtgacactgggagcatttagtaaagactcagaaggatcatgccttaggtaggagctactaccattaaagcaaagccttctctagacaaactccaatgtagccctgaagggataaaactgaccagcaagttatttaggtggctacaaaacaaaacactctaaaagaaaacaaaatctagacacccaacaacaaaatattacaatgtccagcatccaatcttaaaaaatcattaaatatgtaaaaaacaaaaaataaaataaaataaatactaggaaaatacaacccatgaccaagagaaaaaaccaaccaacaaattcagagtgaaaaaattcaagaaatcaataagtaacctgattttcaaacagctattacaaatatgctcaagaattcaaaaaaatacatgaataaaatgaatcaaatggaatttcttgaaatataaagcgaaatatctgaaattatttaacaagggaggagaaaaaacagtaaaatagaagacaaagcaaactgaagcacagggaaataaaaagactgaaaaataatgaatatgatgttaatgacctgtggataataccaaacagtctaacatatgtgtaactggagtcccagaaaaagaggaaatgatgaaagaggagtaaaggtggtaaaaaatatatatatagaagaaacaatggcaacaatcttccaaatttaaggaaaaccataaatgtacagattcaaaaagaaaaaaaaaacaaaaccccaacaactctcagcatggtaatcattgtgcaaatatcatagaacgtacttacacaaatctagattagatggtatagcttactacagaactaggatacatggtatagcccgggtgctcctaggttataaagctgtacagcatgttactatactgaatgaatactgtaagcaactgtaacaaagtgtaagtatttatacatctaaacctagaaaaggtacagtgaaaatatggtggtataatcttaaatgactattgtcaactatgatctcgttgactgaaatgtcagcatgcggcacatgactgtataaccagacttctcatcaaaaacaaatgctgaaagaaaaacacatcaactaaccaagaaaaaagaaacatatatgtccacacagagacttctttttttacacaaatgttcattgtacctttttataatagctgggaactgaaaacagcctggaactgaaaacagcccaggtgtcccttaacagatgaagtcacaaaccaccgaaacattcaacaatatggatgaatctcaaaaacattatgttgagcaaaaagaaactttttacaacatataagtattgtatgactctacttacataaagttctgcgcaagctaaactaagatgaaaacaatctgaacaatgttaggttctaggggtggtgtggggggaaggaataactaggaagaggtgtaggttctataccctgatagaactttctggcaaaggtgtatacatttgtcacagctcatgaaatggtatatgtggtcaactgtattttccaaagatggtcacaatagaagccattccacatgctcttaacaatgtaacactgtcattttttcatcaggtggtggagtctatggcccttctccttgaatctgagtgaaattagtgagtctttcaatccaaagactacagtcatacctcaactatctacagaggactggttccaggactcccatggatcccaaaatccaaggatgcttcgaatcccttatataaaatggcatggtatttgcatataacctacatgcatcttcaaatatgttaaaccatctctagattacttataataccaaatacaatgtaatgctatgtaaacagttgttacaatgtattgtcaaagacaagctctccttgccaatccctgaccaaatgagagattcatgagcaaaataaatagttgctgatatttaaggcactaagtttggggcaatgtattacacagcaataaataactggaacagcatagtaaattctagttaaaaatactaaactactaagttttagttaacatacatgctcaagttaagggtgtggtatactaacaactgcaacttactttgaaaagcataaaaaaagacactagaagaagacaggatggatagatggacaagatagaagacaataacaaatagaacaaaatgttgtgaaattatattctacaattattttaaagtctgtgtggtttgaaaaattgtacgataaaatgaagagtgaaataaagacatttccatacaaacaaaagctgaaagattttgtagccagtagacctatactttagaaatgtttaagaaattttttcaagtaaaaggaaaataacaccagcaacaaacttggatctacaaaaaggaatctccacaaagaaaaataaataaaaatggtaaatatgaaggtaaatataaaggaatgttattcttagtttttaagtttcttcgtaagacaactggcctttgaaagaaatagtttcaaacgctgctgtggaatctataacacatatagaagtaaaatgttaagatcataataccaaaaagaatgagggagagtaaatggatgtatactattccaaaattcttacattatacattaagaggaataatatttttgaaggtagattgaggtaagttaaaggtgcatattgtaaatcctagaagtatcactggggggaaaaaaaacagagggacaagctaataatggagacaatacaaaattccaaaaatgctccattaaccgaaaagaaggcagaaaaggaagaaaagattagacaaatagaaaacaaatagtgtcttaaacacaattatattgccaactgcaataaatgtaaatggacttaatcaaaaag

SEQ ID NO: 2916 - DNA, 1116 bp, Homo sapien
tggcatccagtccactttaccatcagtgtttaaggaaaccatctctgataaggatgactgaggaagagtactctttggcttgttgacaccagcacagctgacacacccagatatctgtttggtctcctgtgaactttcaaccaggatttaaggatgccactctggttaaaagctgaaacaacttcaaggaaacttcagggaaaagagaaggcctggaatctgatcctccacttcagagaacagggagaaaaaagtgcatgtgaaatactactacttatccatctcctggctctgagcagtacatgtcaggaacaagagggaattgtagctggaagacagtagaagagccataggacaagtctctaagagaaggaagaaaaggcgcaatgaaagaaaacaagtttaagatagtagaaaagcattcaaagacggcaacctgaggtggtggagtctatggcccttctccttgaatctgagtgaaattagtgagtctttcaatccaaagactacagtcatacctcaactatctacagaggactggttccaggactcccatggatcccaaaatccaaggatgcttcgaatcccttatataaaatggcatggtatttgcatataacctacatgcatcttcaaatatgttaaaccatctctagattacttataataccaaatacaatgtaatgctatgtaaacagttgttacaatgtattgtcaaagacaagctctccttgccaatccctgaccaaatgagagattcatgagcaaaataaatagttgctgatatttaaggcactaagtttggggcaatgtattacacagcaataaataactggaacagcatagtaaattctagttaaaaatactaaactactaagttttagttaacatacatgctcaagttaagggtgtggtatactaacaactgcaacttactttgaaaagcataaaaaaagacactagaagaagacaggatggatagatggacaagatagaagacaataacaaatagaacaaaatgttgtgaaattatattctacaattattttaaagtctgtgtggtttgaaaaattgtacgataaaatgaagagtgaaataaagacatttccatacaaa

The invention claimed is:
1. A modified oligonucleotide according to the following chemical structure:
(SEQ ID NO: 2873)
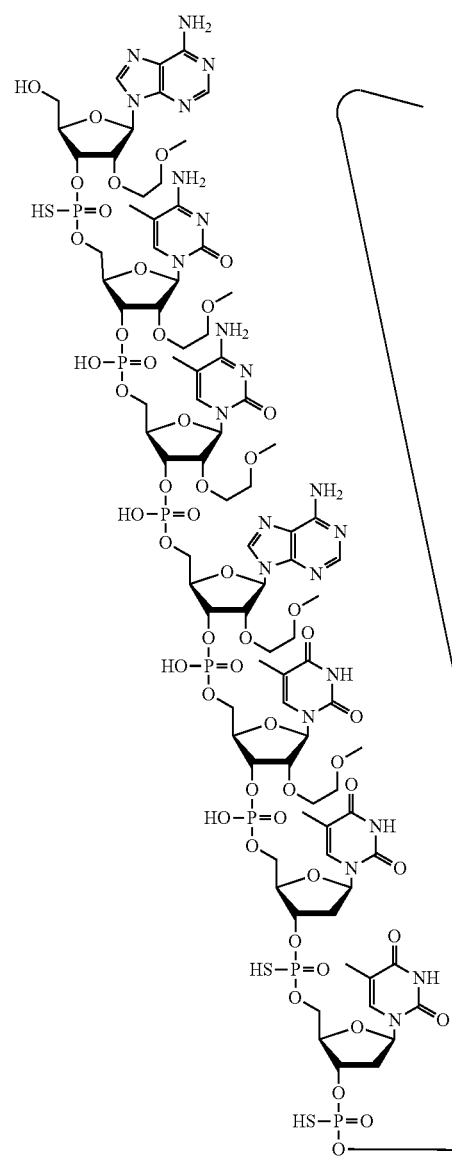
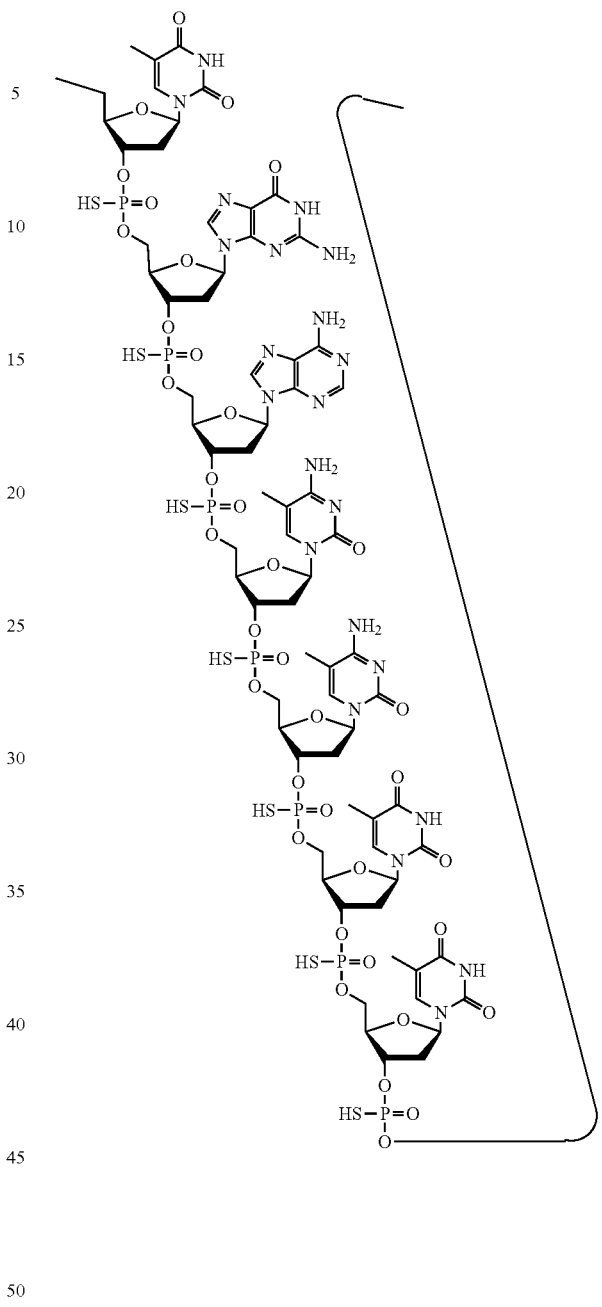

-continued
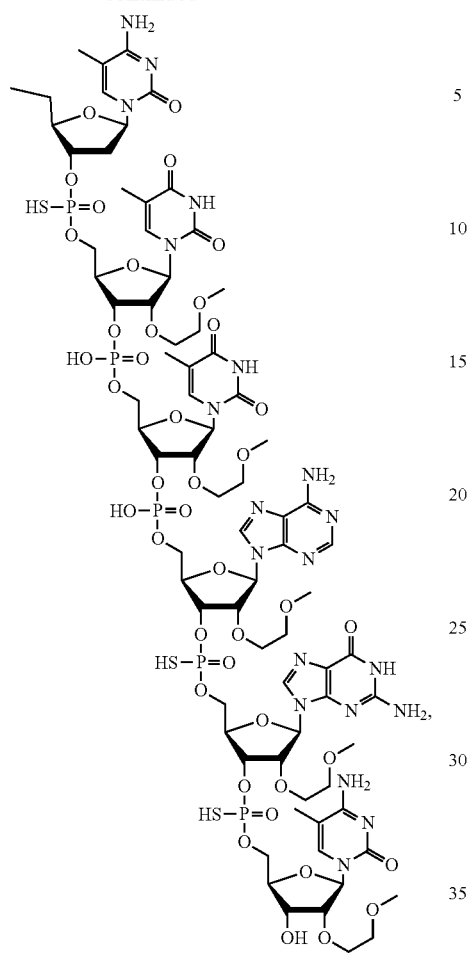
or a salt thereof.
2. The modified oligonucleotide of claim 1, which is the sodium salt or the potassium salt.

3. A modified oligonucleotide according to the following chemical structure:

(SEQ ID NO: 2873)

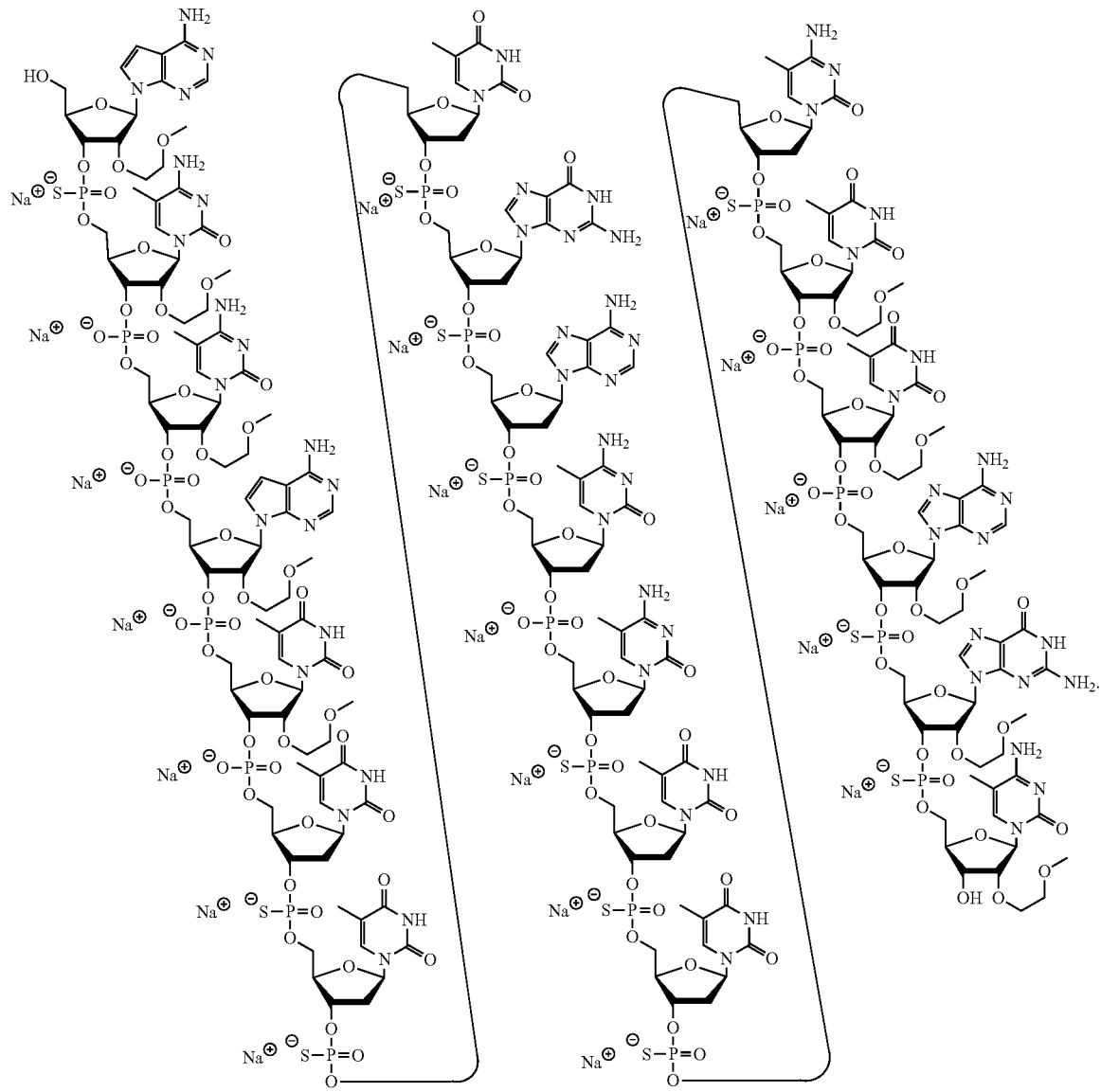

4. A pharmaceutical composition comprising the modified oligonucleotide of claim 1 and a pharmaceutically acceptable diluent.

5. The pharmaceutical composition of claim 4, wherein the pharmaceutically acceptable diluent is artificial cerebrospinal fluid.

6. The pharmaceutical composition of claim 5, wherein the pharmaceutical composition consists essentially of the modified oligonucleotide and artificial cerebrospinal fluid.

7. A pharmaceutical composition comprising the modified oligonucleotide of claim 3 and a pharmaceutically acceptable diluent.

8. The pharmaceutical composition of claim 7, wherein the pharmaceutically acceptable diluent is artificial cerebrospinal fluid.

9. The pharmaceutical composition of claim 8, wherein the pharmaceutical composition consists essentially of the modified oligonucleotide and artificial cerebrospinal fluid.

10. A compound comprising a modified oligonucleotide according to the following chemical notation:

$A_{es}{}^{m}C_{eo}{}^{m}C_{eo}A_{eo}T_{eo}T_{ds}T_{ds}T_{ds}G_{ds}A_{ds}{}^{m}C_{ds}{}^{m}C_{ds}T_{d^-}$ $sT_{ds}{}^{m}C_{ds}T_{eo}T_{eo}A_{es}G_{es}{}^{m}C_{e}$ (SEQ ID NO: 2873), wherein:

A=an adenine nucleobase,
$^{m}$C=a 5-methyl cytosine nucleobase,
G=a guanine nucleobase,
T=a thymine nucleobase,
e=a 2'—O(CH$_2$)$_2$OCH$_3$ β-D-ribosyl sugar moiety,
d=a 2'-β-D-deoxyribosyl sugar moiety,
s=a phosphorothioate internucleoside linkage, and
o=a phosphodiester internucleoside linkage.

11. A pharmaceutical composition comprising a compound of claim 10, and a pharmaceutically acceptable diluent.

12. The pharmaceutical composition of claim 11, wherein the pharmaceutically acceptable diluent is artificial cerebrospinal fluid.

13. The pharmaceutical composition of claim 12, wherein the pharmaceutical composition consists essentially of the compound and artificial cerebrospinal fluid.

14. The compound of claim 10, comprising the modified oligonucleotide covalently linked to a conjugate group.

15. A pharmaceutical composition comprising a compound of claim 14, and a pharmaceutically acceptable diluent.

16. The pharmaceutical composition of claim 15, wherein the pharmaceutically acceptable diluent is artificial cerebrospinal fluid.

17. The pharmaceutical composition of claim 16, wherein the pharmaceutical composition consists essentially of the compound and artificial cerebrospinal fluid.

* * * * *

UNITED STATES PATENT AND TRADEMARK OFFICE
CERTIFICATE OF CORRECTION

PATENT NO. : 11,261,446 B2
APPLICATION NO. : 17/236671
DATED : March 1, 2022
INVENTOR(S) : Paymaan Jafar-nejad Page 1 of 2

It is certified that error appears in the above-identified patent and that said Letters Patent is hereby corrected as shown below:

In the Claims

In Claim 1, Column 329, Line 7, "(SEQ ID NO: 2873)" should be deleted

In Claim 1, Columns 329-331, the structure should read as follows:

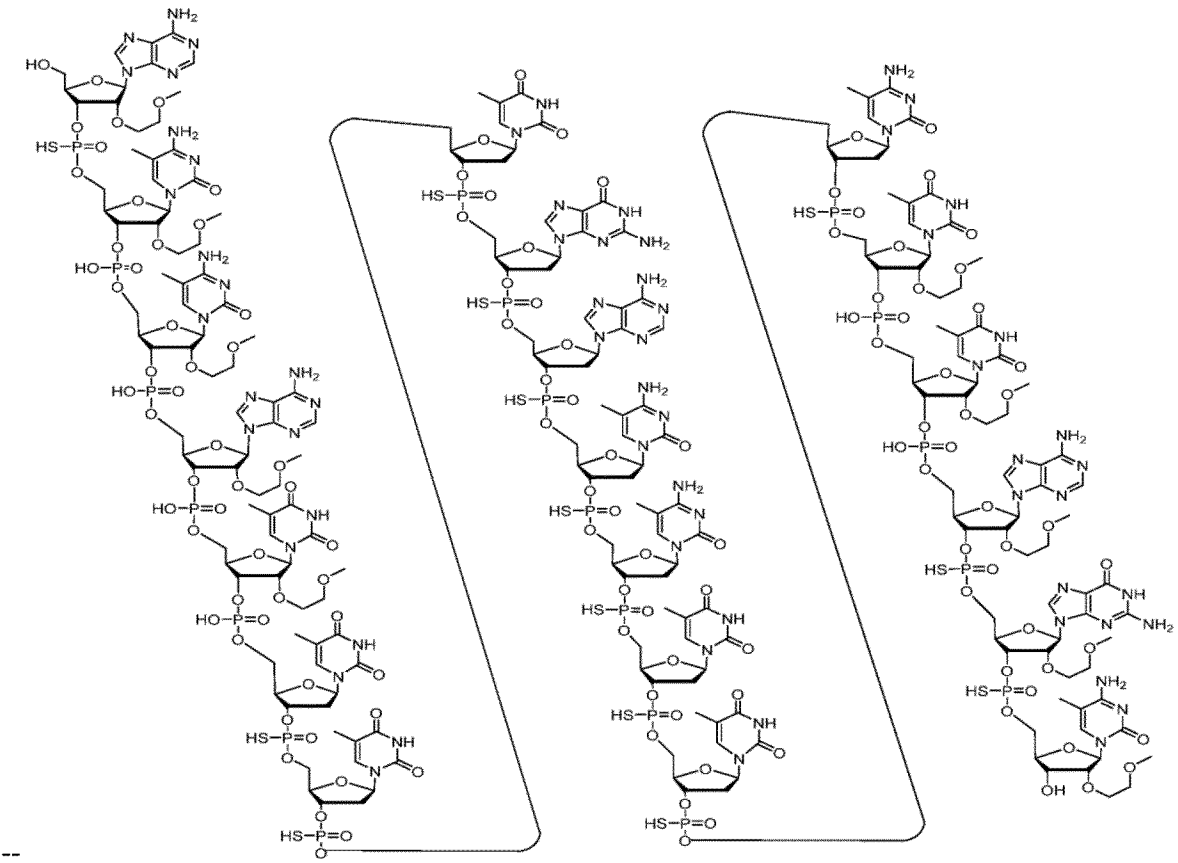

Signed and Sealed this
Twenty-fourth Day of May, 2022

Katherine Kelly Vidal
*Director of the United States Patent and Trademark Office*

CERTIFICATE OF CORRECTION (continued)
U.S. Pat. No. 11,261,446 B2

In Claim 1, Column 331, Line 41, should read --or a salt thereof (SEQ ID NO: 2873).--

In Claim 3, Column 334, "(SEQ ID NO: 2873)" should be deleted

In Claim 3, Column 334, Line 50, the following text should be added: --(SEQ ID NO: 2873).--

In Claim 10, Column 334, Lines 57-58, should read as follows:
--$A_{es}{}^{m}C_{eo}{}^{m}C_{eo}A_{eo}T_{eo}T_{ds}T_{ds}T_{ds}G_{ds}A_{ds}{}^{m}C_{ds}{}^{m}C_{ds}T_{ds}T_{ds}{}^{m}C_{ds}T_{eo}T_{eo}A_{es}G_{es}{}^{m}C_{e}$ (SEQ ID NO: 2873),--